United States Patent
Guerlavais et al.

(10) Patent No.: US 10,023,613 B2
(45) Date of Patent: Jul. 17, 2018

(54) PEPTIDOMIMETIC MACROCYCLES AS MODULATORS OF MCL-1

(71) Applicant: AILERON Therapeutics, Inc., Cambridge, MA (US)

(72) Inventors: Vincent Guerlavais, Arlington, MA (US); Eric Feyfant, Lexington, MA (US)

(73) Assignee: AILERON THERAPEUTICS, INC., Cambridge, MA (US)

( * ) Notice: Subject to any disclaimer, the term of this patent is extended or adjusted under 35 U.S.C. 154(b) by 0 days.

(21) Appl. No.: 15/259,947

(22) Filed: Sep. 8, 2016

(65) Prior Publication Data

US 2017/0107252 A1  Apr. 20, 2017

Related U.S. Application Data

(60) Provisional application No. 62/216,683, filed on Sep. 10, 2015.

(51) Int. Cl.
| A61K 38/00 | (2006.01) |
| A61P 35/00 | (2006.01) |
| C07K 7/06  | (2006.01) |

(52) U.S. Cl.
CPC ............ *C07K 7/06* (2013.01); *A61K 38/00* (2013.01)

(58) Field of Classification Search
CPC ........ A61K 38/00; A61K 38/12; A61K 38/02; A61K 39/0011
See application file for complete search history.

(56) References Cited

U.S. PATENT DOCUMENTS

| | | |
|---|---|---|
| 4,000,259 A | 12/1976 | Garsky |
| 4,191,754 A | 3/1980 | Nutt et al. |
| 4,270,537 A | 6/1981 | Romaine |
| 4,438,270 A | 3/1984 | Bey et al. |
| 4,596,556 A | 6/1986 | Morrow et al. |
| 4,730,006 A | 3/1988 | Bohme et al. |
| 4,737,465 A | 4/1988 | Bond et al. |
| 4,790,824 A | 12/1988 | Morrow et al. |
| 4,886,499 A | 12/1989 | Cirelli et al. |
| 4,940,460 A | 7/1990 | Casey et al. |
| 4,941,880 A | 7/1990 | Burns |
| 5,015,235 A | 5/1991 | Crossman |
| 5,064,413 A | 11/1991 | McKinnon et al. |
| 5,120,859 A | 6/1992 | Webb |
| 5,141,496 A | 8/1992 | Dalto et al. |
| 5,190,521 A | 3/1993 | Hubbard et al. |
| 5,245,009 A | 9/1993 | Kornreich et al. |
| 5,310,910 A | 5/1994 | Drtina et al. |
| 5,312,335 A | 5/1994 | McKinnon et al. |
| 5,328,483 A | 7/1994 | Jacoby |
| 5,334,144 A | 8/1994 | Alchas et al. |
| 5,339,163 A | 8/1994 | Homma et al. |
| 5,364,851 A | 11/1994 | Joran |
| 5,383,851 A | 1/1995 | McKinnon, Jr. et al. |
| 5,384,309 A | 1/1995 | Barker et al. |
| 5,417,662 A | 5/1995 | Hjertman et al. |
| 5,446,128 A | 8/1995 | Kahn |
| 5,466,220 A | 11/1995 | Brenneman |
| 5,480,381 A | 1/1996 | Weston |
| 5,503,627 A | 4/1996 | McKinnon et al. |
| 5,520,639 A | 5/1996 | Peterson et al. |
| 5,527,288 A | 6/1996 | Gross et al. |
| 5,569,189 A | 10/1996 | Parsons |
| 5,599,302 A | 2/1997 | Lilley et al. |
| 5,622,852 A | 4/1997 | Korsmeyer |
| 5,649,912 A | 7/1997 | Peterson |
| 5,650,133 A | 7/1997 | Carvalho et al. |
| 5,663,316 A | 9/1997 | Xudong |
| 5,672,584 A | 9/1997 | Borchardt et al. |
| 5,702,908 A | 12/1997 | Picksley et al. |
| 5,704,911 A | 1/1998 | Parsons |
| 5,708,136 A | 1/1998 | Burrell et al. |
| 5,710,245 A | 1/1998 | Kahn |
| 5,731,408 A | 3/1998 | Hadley et al. |
| 5,750,767 A | 5/1998 | Carpino et al. |
| 5,756,669 A | 5/1998 | Bischoff et al. |
| 5,770,377 A | 6/1998 | Picksley et al. |
| 5,811,515 A | 9/1998 | Grubbs et al. |
| 5,817,752 A | 10/1998 | Yu |
| 5,817,789 A | 10/1998 | Heartlein et al. |
| 5,824,483 A | 10/1998 | Houston, Jr. et al. |
| 5,834,209 A | 11/1998 | Korsmeyer |
| 5,837,845 A | 11/1998 | Hosokawa et al. |
| 5,840,833 A | 11/1998 | Kahn |
| 5,856,445 A | 1/1999 | Korsmeyer |
| 5,859,184 A | 1/1999 | Kahn et al. |
| 5,874,529 A | 2/1999 | Gilon et al. |
| 5,893,397 A | 4/1999 | Peterson et al. |

(Continued)

FOREIGN PATENT DOCUMENTS

| CA | 2700925 A1 | 4/2009 |
| CA | 2761253 A1 | 6/2013 |

(Continued)

OTHER PUBLICATIONS

Barreyro, et al. (2012). Overexpression of IL-1 receptor accessory protein in stem and progenitor cells and outcome correlation in AML and MDS. Blood 120, 1290-1298.

(Continued)

*Primary Examiner* — Hasan S Ahmed
*Assistant Examiner* — Kaipeen E Yang
(74) *Attorney, Agent, or Firm* — Wilson Sonsini Goodrich & Rosati

(57) ABSTRACT

The disclosed peptidomimetic macrocycles modulate the activity of MCL-1. Myeloid cell leukemia 1 (MCL-1) is a protein that inhibits cell death. Peptidomimetic macrocycles, pharmaceutical compositions, and methods disclosed herein can be used for the treatment of disease in which MCL-1 is over-expressed, such as cancer. In particular, MCL-1-modulating peptidomimetic macrocycles disclosed herein can be applied in the setting of resistance to BCL-2 family inhibitors, which is often engendered by MCL-1 over-expression or hyper-activation.

17 Claims, 7 Drawing Sheets

(56) References Cited

U.S. PATENT DOCUMENTS

| | | |
|---|---|---|
| 5,922,863 A | 7/1999 | Grubbs et al. |
| 5,955,593 A | 9/1999 | Korsmeyer |
| 5,965,703 A | 10/1999 | Horne et al. |
| 5,993,412 A | 11/1999 | Deily et al. |
| 5,998,583 A | 12/1999 | Korsmeyer |
| 6,030,997 A | 2/2000 | Eilat et al. |
| 6,031,073 A | 2/2000 | Yu |
| 6,043,339 A | 3/2000 | Lin et al. |
| 6,046,289 A | 4/2000 | Komazawa et al. |
| 6,051,554 A | 4/2000 | Hornik et al. |
| 6,054,556 A | 4/2000 | Huby et al. |
| 6,153,391 A | 11/2000 | Picksley et al. |
| 6,169,073 B1 | 1/2001 | Halazonetis et al. |
| 6,177,076 B1 | 1/2001 | Lattime et al. |
| 6,177,542 B1 | 1/2001 | Ruoslahti et al. |
| 6,184,344 B1 | 2/2001 | Kent et al. |
| 6,204,361 B1 | 3/2001 | Carpino et al. |
| 6,245,886 B1 | 6/2001 | Halazonetis et al. |
| 6,271,198 B1 | 8/2001 | Braisted et al. |
| 6,287,787 B1 | 9/2001 | Houghten et al. |
| 6,326,354 B1 | 12/2001 | Gross et al. |
| 6,348,558 B1 | 2/2002 | Harris et al. |
| 6,420,118 B1 | 7/2002 | Halazonetis et al. |
| 6,420,136 B1 | 7/2002 | Riabowol et al. |
| 6,444,425 B1 | 9/2002 | Reed et al. |
| 6,495,674 B1 | 12/2002 | Lemke et al. |
| 6,514,685 B1 | 2/2003 | Moro |
| 6,569,993 B1 | 5/2003 | Sledeski et al. |
| 6,572,856 B1 | 6/2003 | Taylor et al. |
| 6,610,657 B1 | 8/2003 | Goueli |
| 6,613,874 B1 | 9/2003 | Mazur et al. |
| 6,686,148 B1 | 2/2004 | Shen et al. |
| 6,703,382 B2 | 3/2004 | Wang et al. |
| 6,713,280 B1 | 3/2004 | Huang et al. |
| 6,784,157 B2 | 8/2004 | Halazonetis et al. |
| 6,849,428 B1 | 2/2005 | Evans et al. |
| 6,875,594 B2 | 4/2005 | Muir et al. |
| 6,936,586 B1 | 8/2005 | Larsen et al. |
| 7,064,193 B1 | 6/2006 | Cory et al. |
| 7,083,983 B2 | 8/2006 | Lane et al. |
| 7,084,244 B2 | 8/2006 | Gilon et al. |
| 7,115,372 B2 | 10/2006 | Shen et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,247,700 B2 | 7/2007 | Korsmeyer et al. |
| 7,538,190 B2 | 5/2009 | Robinson et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,737,174 B2 | 6/2010 | Wang et al. |
| 7,745,573 B2 | 6/2010 | Robinson et al. |
| 7,759,383 B2 | 7/2010 | Wang et al. |
| 7,786,072 B2 | 8/2010 | Verdine et al. |
| 7,884,107 B2 | 2/2011 | Ma et al. |
| 7,893,278 B2 | 2/2011 | Haley et al. |
| 7,927,813 B2 | 4/2011 | Geneste et al. |
| 7,932,397 B2 | 4/2011 | Hock et al. |
| 7,960,506 B2 | 6/2011 | Nash |
| 7,964,724 B2 | 6/2011 | Fotouhi et al. |
| 7,981,998 B2 | 7/2011 | Nash |
| 7,981,999 B2 | 7/2011 | Nash |
| 8,017,607 B2 | 9/2011 | Bartkovitz et al. |
| 8,058,269 B2 | 11/2011 | Chen et al. |
| 8,071,541 B2 | 12/2011 | Arora et al. |
| 8,076,482 B2 | 12/2011 | Chen et al. |
| 8,088,815 B2 | 1/2012 | Bartkovitz et al. |
| 8,088,931 B2 | 1/2012 | Wang et al. |
| 8,124,726 B2 | 2/2012 | Robinson et al. |
| 8,198,405 B2 | 6/2012 | Walensky et al. |
| 8,217,051 B2 | 7/2012 | Zhang et al. |
| 8,324,428 B2 | 12/2012 | Verdine et al. |
| 8,343,760 B2 | 1/2013 | Lu et al. |
| 8,389,484 B2 | 3/2013 | Shen et al. |
| 8,399,405 B2 | 3/2013 | Nash et al. |
| 8,524,653 B2 | 9/2013 | Nash et al. |
| 8,592,377 B2 | 11/2013 | Verdine et al. |
| 8,609,809 B2 | 12/2013 | Nash |
| 8,637,686 B2 | 1/2014 | Nash |
| 8,796,418 B2 | 8/2014 | Walensky et al. |
| 8,808,694 B2 | 8/2014 | Nash et al. |
| 8,859,723 B2 | 10/2014 | Guerlavais et al. |
| 8,871,899 B2 | 10/2014 | Wang et al. |
| 8,889,632 B2 | 11/2014 | Bernal et al. |
| 8,895,699 B2 | 11/2014 | Verdine et al. |
| 8,927,500 B2 | 1/2015 | Guerlavais et al. |
| 8,957,026 B2 | 2/2015 | Verdine et al. |
| 8,987,414 B2 | 3/2015 | Guerlavais et al. |
| 9,023,988 B2 | 5/2015 | Nash |
| 9,096,684 B2 | 8/2015 | Kawahata et al. |
| 9,163,330 B2 | 10/2015 | Verdine et al. |
| 9,175,045 B2 | 11/2015 | Nash et al. |
| 9,175,047 B2 | 11/2015 | Nash et al. |
| 9,175,056 B2 | 11/2015 | Nash |
| 9,206,223 B2 | 12/2015 | Nash et al. |
| 9,273,031 B2 | 3/2016 | Errico et al. |
| 9,273,099 B2 | 3/2016 | Walensky et al. |
| 9,381,228 B2 | 7/2016 | Robson et al. |
| 9,394,336 B2 | 7/2016 | Nash et al. |
| 9,408,885 B2 | 8/2016 | Marine et al. |
| 9,458,202 B2 | 10/2016 | Nash et al. |
| 9,464,115 B2 | 10/2016 | Walensky et al. |
| 9,486,445 B2 | 11/2016 | Higgins et al. |
| 9,493,509 B2 | 11/2016 | Nash et al. |
| 9,505,801 B2 | 11/2016 | Verdine et al. |
| 9,505,804 B2 | 11/2016 | Guerlavais et al. |
| 9,522,947 B2 | 12/2016 | Kawahata et al. |
| 9,527,896 B2 | 12/2016 | Bernal et al. |
| 9,845,287 B2 | 12/2017 | Darlak et al. |
| 2002/0098580 A1 | 7/2002 | Nandabalan et al. |
| 2002/0132977 A1 | 9/2002 | Yuan et al. |
| 2003/0027766 A1 | 2/2003 | Ioannides et al. |
| 2003/0060432 A1 | 3/2003 | Tocque et al. |
| 2003/0144331 A1 | 7/2003 | Gudkov et al. |
| 2003/0166138 A1 | 9/2003 | Kinsella et al. |
| 2003/0176318 A1 | 9/2003 | Gudkov et al. |
| 2004/0023887 A1 | 2/2004 | Pillutla et al. |
| 2004/0038901 A1 | 2/2004 | Basler et al. |
| 2004/0067503 A1 | 4/2004 | Tan et al. |
| 2004/0106159 A1 | 6/2004 | Kern et al. |
| 2004/0106548 A1 | 6/2004 | Schmidt et al. |
| 2004/0115135 A1 | 6/2004 | Quay |
| 2004/0146971 A1 | 7/2004 | Lane et al. |
| 2004/0152708 A1 | 8/2004 | Li et al. |
| 2004/0170653 A1 | 9/2004 | Stanislawski et al. |
| 2004/0170971 A1 | 9/2004 | Kinzler et al. |
| 2004/0171809 A1 | 9/2004 | Korsmeyer et al. |
| 2004/0228866 A1 | 11/2004 | Lu |
| 2004/0230380 A1 | 11/2004 | Chirino et al. |
| 2004/0235746 A1 | 11/2004 | Hawiger et al. |
| 2004/0248198 A1 | 12/2004 | Kriwacki et al. |
| 2004/0265931 A1 | 12/2004 | Gu et al. |
| 2005/0013820 A1 | 1/2005 | Holoshitz et al. |
| 2005/0037383 A1 | 2/2005 | Taremi et al. |
| 2005/0089511 A1 | 4/2005 | Roth et al. |
| 2005/0119167 A1 | 6/2005 | Abbenante et al. |
| 2005/0137137 A1 | 6/2005 | Lane et al. |
| 2005/0176075 A1 | 8/2005 | Jones et al. |
| 2005/0222224 A1 | 10/2005 | Gudkov et al. |
| 2005/0222427 A1 | 10/2005 | Sharpless et al. |
| 2005/0227932 A1 | 10/2005 | Lu et al. |
| 2005/0250680 A1 | 11/2005 | Walensky et al. |
| 2005/0277764 A1 | 12/2005 | Boyd et al. |
| 2006/0008848 A1 | 1/2006 | Verdine et al. |
| 2006/0014675 A1 | 1/2006 | Arora et al. |
| 2006/0073518 A1 | 4/2006 | Timmerman et al. |
| 2006/0100143 A1 | 5/2006 | Lu et al. |
| 2006/0111411 A1 | 5/2006 | Cooper et al. |
| 2006/0148715 A1 | 7/2006 | Tweardy |
| 2006/0149039 A1 | 7/2006 | Hunter et al. |
| 2006/0189511 A1 | 8/2006 | Koblish et al. |
| 2006/0233779 A1 | 10/2006 | Ben-Avraham et al. |
| 2006/0293380 A1 | 12/2006 | Nantermet et al. |

(56) References Cited

U.S. PATENT DOCUMENTS

| | | |
|---|---|---|
| 2007/0006332 A1 | 1/2007 | O'Neill |
| 2007/0020620 A1 | 1/2007 | Finn et al. |
| 2007/0032417 A1 | 2/2007 | Baell |
| 2007/0129324 A1 | 6/2007 | Boyd et al. |
| 2007/0161544 A1 | 7/2007 | Wipf et al. |
| 2007/0161690 A1 | 7/2007 | Castro et al. |
| 2007/0197772 A1 | 8/2007 | Arora et al. |
| 2007/0274915 A1 | 11/2007 | Rao et al. |
| 2008/0081038 A1 | 4/2008 | Cho et al. |
| 2008/0085279 A1 | 4/2008 | Boyd et al. |
| 2008/0132485 A1 | 6/2008 | Wang et al. |
| 2008/0161426 A1 | 7/2008 | Gudkov et al. |
| 2008/0213175 A1 | 9/2008 | Kolb et al. |
| 2008/0234183 A1 | 9/2008 | Hallbrink et al. |
| 2008/0242598 A1 | 10/2008 | Fairlie et al. |
| 2008/0250515 A1 | 10/2008 | Reed |
| 2008/0262200 A1 | 10/2008 | Nash |
| 2008/0305490 A1 | 12/2008 | Burrell et al. |
| 2008/0311608 A1 | 12/2008 | Tocque et al. |
| 2009/0047711 A1 | 2/2009 | Nash |
| 2009/0054331 A1 | 2/2009 | Chen et al. |
| 2009/0088553 A1 | 4/2009 | Nash |
| 2009/0149630 A1 | 6/2009 | Walensky et al. |
| 2009/0176964 A1 | 7/2009 | Walensky et al. |
| 2009/0275519 A1 | 11/2009 | Nash et al. |
| 2009/0311174 A1 | 12/2009 | Allen |
| 2009/0326192 A1 | 12/2009 | Nash et al. |
| 2010/0010065 A1 | 1/2010 | Smith |
| 2010/0081611 A1 | 4/2010 | Bradner et al. |
| 2010/0093057 A1 | 4/2010 | Beattie et al. |
| 2010/0093086 A1 | 4/2010 | Lin et al. |
| 2010/0168388 A1 | 7/2010 | Bernal et al. |
| 2010/0184628 A1 | 7/2010 | Nash |
| 2010/0184645 A1 | 7/2010 | Verdine et al. |
| 2010/0210515 A1 | 8/2010 | Nash et al. |
| 2010/0216688 A1 | 8/2010 | Nash et al. |
| 2010/0234563 A1 | 9/2010 | Arora et al. |
| 2010/0273704 A1 | 10/2010 | Korsmeyer et al. |
| 2010/0286362 A1 | 11/2010 | Boyd et al. |
| 2010/0298201 A1 | 11/2010 | Nash et al. |
| 2011/0021529 A1 | 1/2011 | Lain et al. |
| 2011/0028753 A1 | 2/2011 | Verdine et al. |
| 2011/0046043 A1 | 2/2011 | Wang et al. |
| 2011/0065915 A1 | 3/2011 | Malcolmson et al. |
| 2011/0144303 A1 | 6/2011 | Nash et al. |
| 2011/0144306 A1 | 6/2011 | Verdine et al. |
| 2011/0183917 A1 | 7/2011 | Lu et al. |
| 2011/0218155 A1 | 9/2011 | Walensky et al. |
| 2011/0223149 A1 | 9/2011 | Nash et al. |
| 2011/0245175 A1 | 10/2011 | Arora et al. |
| 2011/0245477 A1 | 10/2011 | Hoveyda et al. |
| 2011/0250685 A1 | 10/2011 | Nash |
| 2011/0251252 A1 | 10/2011 | Wang et al. |
| 2011/0263815 A1 | 10/2011 | Nash |
| 2011/0313167 A1 | 12/2011 | Doemling |
| 2012/0040889 A1 | 2/2012 | Nash et al. |
| 2012/0082636 A1 | 4/2012 | Walensky et al. |
| 2012/0101047 A1 | 4/2012 | Nash et al. |
| 2012/0115783 A1 | 5/2012 | Nash et al. |
| 2012/0115793 A1 | 5/2012 | Nash et al. |
| 2012/0149648 A1 | 6/2012 | Nash et al. |
| 2012/0156197 A1 | 6/2012 | Errico et al. |
| 2012/0172311 A1 | 7/2012 | Nash et al. |
| 2012/0178700 A1 | 7/2012 | Nash et al. |
| 2012/0238507 A1 | 9/2012 | Fairlie et al. |
| 2012/0264674 A1 | 10/2012 | Nash et al. |
| 2012/0264738 A1 | 10/2012 | Sugimoto et al. |
| 2012/0270800 A1 | 10/2012 | Verdine et al. |
| 2012/0283269 A1 | 11/2012 | Blagosklonny et al. |
| 2012/0328692 A1 | 12/2012 | Lu et al. |
| 2013/0005943 A1 | 1/2013 | Arora et al. |
| 2013/0023646 A1 | 1/2013 | Nash et al. |
| 2013/0072439 A1 | 3/2013 | Nash et al. |
| 2013/0123196 A1 | 5/2013 | Arora et al. |
| 2013/0177979 A1 | 7/2013 | Turkson |
| 2013/0210743 A1 | 8/2013 | Guerlavais et al. |
| 2013/0211046 A1 | 8/2013 | Verdine et al. |
| 2013/0274205 A1 | 10/2013 | Guerlavais et al. |
| 2013/0330421 A1 | 12/2013 | Marine |
| 2014/0005118 A1 | 1/2014 | Verdine et al. |
| 2014/0011979 A1 | 1/2014 | Verdine et al. |
| 2014/0018302 A1 | 1/2014 | Walensky et al. |
| 2014/0051828 A1 | 2/2014 | Arora et al. |
| 2014/0128581 A1 | 5/2014 | Darlak et al. |
| 2014/0162339 A1 | 6/2014 | Verdine et al. |
| 2014/0235549 A1 | 8/2014 | Moellering et al. |
| 2014/0256912 A1 | 9/2014 | Moellering et al. |
| 2014/0296160 A1 | 10/2014 | Walensky et al. |
| 2014/0323701 A1 | 10/2014 | Nash et al. |
| 2014/0378390 A1 | 12/2014 | Guerlavais et al. |
| 2015/0038430 A1 | 2/2015 | Nash et al. |
| 2015/0051155 A1 | 2/2015 | Guerlavais et al. |
| 2015/0056612 A1 | 2/2015 | Shen et al. |
| 2015/0119551 A1 | 4/2015 | Bernal et al. |
| 2015/0157603 A1 | 6/2015 | Higgins et al. |
| 2015/0183825 A1 | 7/2015 | Guerlavais et al. |
| 2015/0225471 A1 | 8/2015 | Liang et al. |
| 2015/0239937 A1 | 8/2015 | Verdine et al. |
| 2017/0008930 A1 | 1/2017 | Walensky et al. |
| 2017/0088581 A1 | 3/2017 | Verdine et al. |
| 2017/0296620 A1 | 10/2017 | Nash |
| 2017/0298099 A1 | 10/2017 | Nash et al. |
| 2017/0360881 A1 | 12/2017 | Samant et al. |

FOREIGN PATENT DOCUMENTS

| | | |
|---|---|---|
| CN | 1252808 A | 5/2000 |
| CN | 1583730 A | 2/2005 |
| CN | 101636407 A | 1/2010 |
| CN | 102223891 A | 10/2011 |
| CZ | 9700369 A3 | 9/1998 |
| EP | 0467699 A2 | 1/1992 |
| EP | 0467699 A3 | 2/1993 |
| EP | 0528312 A2 | 2/1993 |
| EP | 0552417 A1 | 7/1993 |
| EP | 0729972 A1 | 9/1996 |
| EP | 0643726 B1 | 8/1999 |
| EP | 0977580 B1 | 4/2003 |
| EP | 1321474 A1 | 6/2003 |
| EP | 1452868 A2 | 9/2004 |
| EP | 1541692 A1 | 6/2005 |
| EP | 1602663 A1 | 12/2005 |
| EP | 1609802 A1 | 12/2005 |
| EP | 1243923 B1 | 3/2006 |
| EP | 1180016 B1 | 9/2006 |
| EP | 0958305 B1 | 6/2008 |
| EP | 2091552 A2 | 8/2009 |
| EP | 1597585 B1 | 6/2011 |
| EP | 2377849 A2 | 10/2011 |
| EP | 2488193 A1 | 8/2012 |
| EP | 2489360 A1 | 8/2012 |
| EP | 2114428 B1 | 10/2012 |
| EP | 2637680 A2 | 9/2013 |
| JP | 2002524391 A | 8/2002 |
| JP | 2010518017 A | 5/2010 |
| JP | 2010120881 A | 6/2010 |
| JP | 2010519318 A | 6/2010 |
| JP | 2012503025 A | 2/2012 |
| WO | WO-8909233 A1 | 10/1989 |
| WO | WO-8912675 A1 | 12/1989 |
| WO | WO-9206998 A1 | 4/1992 |
| WO | WO-9213878 A2 | 8/1992 |
| WO | WO-9301203 A1 | 1/1993 |
| WO | WO-9307170 A1 | 4/1993 |
| WO | WO-9422910 A1 | 10/1994 |
| WO | WO-9425482 A1 | 11/1994 |
| WO | WO-9500534 A1 | 1/1995 |
| WO | WO-9522546 A1 | 8/1995 |
| WO | WO-9602642 A1 | 2/1996 |
| WO | WO-9620951 A1 | 7/1996 |
| WO | WO-9628449 A1 | 9/1996 |
| WO | WO-9634878 A1 | 11/1996 |
| WO | WO-9700267 A1 | 1/1997 |
| WO | WO-9713537 A1 | 4/1997 |

(56) References Cited

FOREIGN PATENT DOCUMENTS

| | | |
|---|---|---|
| WO | WO-9714794 A1 | 4/1997 |
| WO | WO-9730072 A1 | 8/1997 |
| WO | WO-9737705 A1 | 10/1997 |
| WO | WO-9801467 A2 | 1/1998 |
| WO | WO-9817625 A1 | 4/1998 |
| WO | WO-9846631 A1 | 10/1998 |
| WO | WO-9847525 A1 | 10/1998 |
| WO | WO-9914259 A1 | 3/1999 |
| WO | WO-9934833 A1 | 7/1999 |
| WO | WO-9934850 A1 | 7/1999 |
| WO | WO-9963929 A2 | 12/1999 |
| WO | WO-0006187 A2 | 2/2000 |
| WO | WO-0006187 A3 | 5/2000 |
| WO | WO-02064790 A2 | 8/2002 |
| WO | WO-02070547 A1 | 9/2002 |
| WO | WO-02072597 A2 | 9/2002 |
| WO | WO-02064790 A3 | 5/2003 |
| WO | WO-03054000 A1 | 7/2003 |
| WO | WO-03059933 A2 | 7/2003 |
| WO | WO-03070892 A2 | 8/2003 |
| WO | WO-03102538 A2 | 12/2003 |
| WO | WO-03106491 A2 | 12/2003 |
| WO | WO-03059933 A3 | 1/2004 |
| WO | WO-2004026896 A2 | 4/2004 |
| WO | WO-2004041275 A1 | 5/2004 |
| WO | WO-2004058804 A1 | 7/2004 |
| WO | WO-2004077062 A2 | 9/2004 |
| WO | WO-03070892 A3 | 11/2004 |
| WO | WO-03106491 A3 | 12/2004 |
| WO | WO-2004077062 A3 | 1/2005 |
| WO | WO-2005001023 A2 | 1/2005 |
| WO | WO-2005007675 A2 | 1/2005 |
| WO | WO-2004077062 B1 | 2/2005 |
| WO | WO-2005012335 A1 | 2/2005 |
| WO | WO-2005040202 A2 | 5/2005 |
| WO | WO-2005044839 A2 | 5/2005 |
| WO | WO-2005040202 A3 | 6/2005 |
| WO | WO-2005007675 A3 | 7/2005 |
| WO | WO-2005044839 A3 | 7/2005 |
| WO | WO-2005074521 A2 | 8/2005 |
| WO | WO-2005085457 A2 | 9/2005 |
| WO | WO-2005090388 A1 | 9/2005 |
| WO | WO-2005118620 A2 | 12/2005 |
| WO | WO-2005118625 A1 | 12/2005 |
| WO | WO-2005118634 A2 | 12/2005 |
| WO | WO-2005118634 A3 | 5/2006 |
| WO | WO-2005118620 A3 | 6/2006 |
| WO | WO-2006078161 A1 | 7/2006 |
| WO | WO-2006103666 A2 | 10/2006 |
| WO | WO-2006137974 A2 | 12/2006 |
| WO | WO-2006103666 A3 | 3/2007 |
| WO | WO-2007141533 A2 | 12/2007 |
| WO | WO-2008013454 A2 | 1/2008 |
| WO | WO-2008014216 A1 | 1/2008 |
| WO | WO-2008040000 A2 | 4/2008 |
| WO | WO-2008045238 A2 | 4/2008 |
| WO | WO-2008061192 A2 | 5/2008 |
| WO | WO-2008074895 A1 | 6/2008 |
| WO | WO-2008076904 A1 | 6/2008 |
| WO | WO-2007141533 A3 | 7/2008 |
| WO | WO-2008061192 A3 | 7/2008 |
| WO | WO-2008092281 A1 | 8/2008 |
| WO | WO-2008095063 A1 | 8/2008 |
| WO | WO-2008104000 A2 | 8/2008 |
| WO | WO-2008106507 A2 | 9/2008 |
| WO | WO-2008121767 A2 | 10/2008 |
| WO | WO-2008104000 A3 | 11/2008 |
| WO | WO-2008137633 A2 | 11/2008 |
| WO | WO-2008121767 A3 | 1/2009 |
| WO | WO-2009042237 A2 | 4/2009 |
| WO | WO-2009089004 A1 | 7/2009 |
| WO | WO-2009099677 A2 | 8/2009 |
| WO | WO-2009110952 A2 | 9/2009 |
| WO | WO-2009126292 A2 | 10/2009 |
| WO | WO-2009137532 A1 | 11/2009 |
| WO | WO-2009042237 A3 | 12/2009 |
| WO | WO-2009149214 A2 | 12/2009 |
| WO | WO-2009149339 A2 | 12/2009 |
| WO | WO-2010011313 A2 | 1/2010 |
| WO | WO-2010013011 A1 | 2/2010 |
| WO | WO-2010033617 A2 | 3/2010 |
| WO | WO-2010033879 A2 | 3/2010 |
| WO | WO-2010034026 A1 | 3/2010 |
| WO | WO-2010034028 A1 | 3/2010 |
| WO | WO-2010034029 A1 | 3/2010 |
| WO | WO-2010034031 A1 | 3/2010 |
| WO | WO-2010034032 A2 | 3/2010 |
| WO | WO-2010034034 A1 | 3/2010 |
| WO | WO-2010058819 A1 | 5/2010 |
| WO | WO-2010060112 A1 | 5/2010 |
| WO | WO-2010068684 A2 | 6/2010 |
| WO | WO-2010083347 A2 | 7/2010 |
| WO | WO-2010083501 A2 | 7/2010 |
| WO | WO-2010100351 A1 | 9/2010 |
| WO | WO-2010107485 A1 | 9/2010 |
| WO | WO-2010011313 A3 | 12/2010 |
| WO | WO-2011005219 A1 | 1/2011 |
| WO | WO-2011008260 A2 | 1/2011 |
| WO | WO-2011008260 A3 | 3/2011 |
| WO | WO-2011023677 A1 | 3/2011 |
| WO | WO-2011038049 A1 | 3/2011 |
| WO | WO-2011047215 A1 | 4/2011 |
| WO | WO-2011060049 A2 | 5/2011 |
| WO | WO-2011061139 A1 | 5/2011 |
| WO | WO-2011076786 A1 | 6/2011 |
| WO | WO-2011090297 A2 | 7/2011 |
| WO | WO-2011101297 A1 | 8/2011 |
| WO | WO-2011106650 A2 | 9/2011 |
| WO | WO-2011161699 A2 | 12/2011 |
| WO | WO-2011133948 A3 | 1/2012 |
| WO | WO-2012016186 A1 | 2/2012 |
| WO | WO-2012021874 A1 | 2/2012 |
| WO | WO-2012021875 A1 | 2/2012 |
| WO | WO-2012021876 A2 | 2/2012 |
| WO | WO-2012033525 A2 | 3/2012 |
| WO | WO-2012034954 A1 | 3/2012 |
| WO | WO-2012038307 A1 | 3/2012 |
| WO | WO-2012040459 A2 | 3/2012 |
| WO | WO-2012045018 A1 | 4/2012 |
| WO | WO-2012047587 A2 | 4/2012 |
| WO | WO-2012051405 A1 | 4/2012 |
| WO | WO-2012059696 A1 | 5/2012 |
| WO | WO-2012065022 A2 | 5/2012 |
| WO | WO-2012065181 A2 | 5/2012 |
| WO | WO-2012066095 A1 | 5/2012 |
| WO | WO-2012040459 A3 | 6/2012 |
| WO | WO-2012076513 A1 | 6/2012 |
| WO | WO-2012080376 A1 | 6/2012 |
| WO | WO-2012083078 A2 | 6/2012 |
| WO | WO-2012083181 A1 | 6/2012 |
| WO | WO-2012121057 A1 | 9/2012 |
| WO | WO-2012122059 A1 | 9/2012 |
| WO | WO-2012149563 A1 | 11/2012 |
| WO | WO-2012173846 A2 | 12/2012 |
| WO | WO-2012174423 A1 | 12/2012 |
| WO | WO-2012175962 A1 | 12/2012 |
| WO | WO-2013033645 A1 | 3/2013 |
| WO | WO-2013036208 A1 | 3/2013 |
| WO | WO-2013049250 A1 | 4/2013 |
| WO | WO-2013059525 A1 | 4/2013 |
| WO | WO-2013059530 A2 | 4/2013 |
| WO | WO-2013116829 A1 | 8/2013 |
| WO | WO-2013123266 A1 | 8/2013 |
| WO | WO-2013123267 A1 | 8/2013 |
| WO | WO-2014052647 A2 | 4/2014 |
| WO | WO-2014055564 A1 | 4/2014 |
| WO | WO-2014071241 A1 | 5/2014 |
| WO | WO-2014138429 A2 | 9/2014 |
| WO | WO-2017040990 A1 | 3/2017 |
| WO | WO-2017044633 A1 | 3/2017 |

(56) References Cited

FOREIGN PATENT DOCUMENTS

| WO | WO-2017205786 A1 | 11/2017 |
| WO | WO-2017218949 A2 | 12/2017 |

OTHER PUBLICATIONS

Bertrand, et al. (1998). Localization of ASH1 mRNA particles in living yeast. Mol Cell 2, 437-445.
Co-pending U.S. Appl. No. 15/493,301, filed Apr. 21, 2017.
Ishikawa, et al. (2007). Chemotherapy-resistant human AML stem cells home to and engraft within the bone-marrow endosteal region. Nat Biotechnol 25, 1315-1321.
Kandoth et al. Mutational landscape and significance across 12 major cancer types. Nature 502(7471):333-339 (2013).
Korinek et al. Depletion of epithelial stem-cell compartments in the small intestine of mice lacking Tcf-4. Nat Genet 19(4):379-383 (1998).
Lessene, et al. BCL-2 family antagonists for cancer therapy. Nature reviews Drug discovery 7.12 (2008): 989-1000.
Li; et al., "A versatile platform to analyze low-affinity and transient protein-protein interactions in living cells in real time.", 2014, 9(5):, 1946-58.
Mott, et al. Piercing the armor of hepatobiliary cancer: Bcl[2 homology domain 3 (BH3) mimetics and cell death. Hepatology 46.3 (2007): 906-911.
Passegue, et al. (2003). Normal and leukemic hematopoiesis: are leukemias a stem cell disorder or a reacquisition of stem cell characteristics? Proc Natl Acad Sci U S A 100 Suppl 1, 11842-11849.
Qi, J., et al. (2015). HDAC8 Inhibition Specifically Targets Inv(16) Acute Myeloid Leukemic Stem Cells by Restoring p53 Acetylation. Cell Stem Cell 17, 597-610.
Ross et al. Inhibition of adipogenesis by Wnt signaling. Science 289:950-953 (2000).
Takeda et al. Human sebaceous tumors harbor inactivating mutations in LEF I . Nat Med. 12(4):395-397 (2006).
Takeishi, et al. (2013). Ablation of Fbxw7 eliminates leukemia-initiating cells by preventing quiescence. Cancer Cell 23, 347-361.
Tan, et al. (2014). High Mdm4 levels suppress p53 activity and enhance its half-life in acute myeloid leukaemia. Oncotarget 5, 933-943.
Tian et al.; The role of the Wnt-signaling antagonist DKKI in the development of osteolytic lesions in multiple myeloma. N Engl J Med 349:2483-3494 (2003).
Walensky et al., A stapled BID BH3 helix directly binds and activates BAX. (2006) Mol Cell 24:199-210.
Walensky, et al. Activation of apoptosis in vivo by a hydrocarbon-stapled BH3 helix. Science. 2004;305(5689):1466-1470.
Zeisig, et al. (2012). SnapShot: Acute myeloid leukemia. Cancer Cell 22, 698-698 e691.
Andrews et al. Forming Stable Helical Peptide Using Natural and Artificial Amino Acids. Tetrahedron. 1999;55:11711-11743.
Baell, J.B. Prospects for Targeting the Bcl-2 Family of Proteins to Develop Novel cytotoxic drugs. Biochem Pharmacol. Sep. 2002;64(5-6):851-63.
Chin & Schepartz, "Design and Evolution of a Miniature Bcl-2 Binding Protein," Angew. Chem. Int. Ed. 40(20):3806-3809 (2001).
Co-pending U.S. Appl. No. 13/494,846, filed Jun. 12, 2012.
Co-pending U.S. Appl. No. 13/655,442, filed Oct. 18, 2010.
Co-pending U.S. Appl. No. 15/226,059, filed Aug. 2, 2016.
Co-pending U.S. Appl. No. 15/229,517, filed Aug. 5, 2016.
Co-pending U.S. Appl. No. 15/233,796, filed Aug. 10, 2016.
Co-pending U.S. Appl. No. 15/240,505, filed Aug. 18, 2016.
Co-pending U.S. Appl. No. 15/256,130, filed Sep. 2, 2016.
Co-pending U.S. Appl. No. 15/257,807, filed Sep. 6, 2016.
Co-pending U.S. Appl. No. 15/278,824, filed Sep. 28, 2016.
Co-pending U.S. Appl. No. 15/332,492, filed Oct. 24, 2016.
Cory et al., "The Bcl-2 Family: Roles in Cell Survival and Oncogenesis," Oncogene 22:8590-8607 (2003).
Danial et al., Dual role of proapoptotic BAD in insulin secretion and beta cell survival. Nat Med. Feb. 2008;14(2):144-53. doi: 10.1038/nm1717. Epub Jan. 27, 2008.
Darnell, Transcription factors as targets for cancer therapy. Nat Rev Cancer. Oct. 2002;2(10):740-9.
Degterev et al. Identification of Small-molecule Inhibitors of Interaction between the BH3 Domain and Bcl-xL. Nature Cell Biol. 3:173-182 (2001).
Fischer, et al. Apoptosis-based therapies and drug targets. Cell Death and Differentiation. 2005; 12:942-961.
Fulda, et al. Extrinsic versus intrinsic apoptosis pathways in anticancer chemotherapy. Oncogene. Aug. 7, 2006;25(34):4798-811.
Gavathiotis et al., BAX activation is initiated at a novel interaction site. Nature. Oct. 23, 2008;455(7216):1076-81.
Gemperli et al., "Paralog-selective Ligands for Bcl-2 Proteins," J. Am. Chem. Soc. 127:1596-1597 (2005).
Jamieson et al., Granulocyte-macrophage progenitors as candidate leukemic stem cells in blast-crisis CML. N Engl J Med. Aug. 12, 2004;351(7):657-67.
Joseph, et al. Stapled BH3 peptides against MCL-1: mechanism and design using atomistic simulations. PloS one 7.8 (2012): e43985.
Kawamoto, Targeting the BCL9/B9L binding interaction with beta-catenin as a potential anticancer strategy. PhD Thesis. Jun. 3, 2010. Available at http://deepblue.lib.umich.edu/handle/2027.42/75846 last accessed Apr. 9, 2012. Abstract only. 2 pages.
Kutzki et al., "Development of a Potent Bcl-xL Antagonist Based on α-Helix Mimicry," J. Am. Chem. Soc. 124:11838-11839 (2002).
Lee, et al. A novel BH3 ligand that selectively targets Mcl-1 reveals that apoptosis can proceed without Mcl-1 degradation. J Cell Biol. Jan. 28, 2008;180(2):341-355.
Letai, et al. Distinct BH3 Domains Either Sensitize or Activate Mitochondrial Apoptosis, Serving as Prototype Cancer Therapeutics. Cancer Cell. 2002; 2:183-192.
Muchmore, et al. X-ray and NMR structure of human Bcl-xL, an inhibitor of programmed cell death. Nature. May 23, 1996;381(6580):335-41.
Petros et al., "Rationale for Bcl-xL/Bad Peptide Complex Formation from Structure, Mutagenesis, and Biophysical Studies," Protein Sci. 9:2528-2534 (2000).
Ruffolo and Shore. BCL-2 Selectively Interacts with the BID-Induced Open Conformer of BAK, Inhibiting BAK Auto-Oligomerization. J. Biol. Chern. 2003;278(27):25039-25045.
Rutledge et al., "A View to a Kill: Ligands for Bcl-2 Family Proteins," Curr. Opin. Chem. Biol. 6:479-485 (2002).
Sanchez-Garcia, et al. Tumorigenic activity of the BCR-ABL oncogenes is mediated by BCL2. Proc Natl Acad Sci U S A. Jun. 6, 1995;92(12):5287-91.
Sattler et al. Structure of Bcl-xL-Back peptide complex: recognition between regulators of apoptosis. Science. 275:983-986 (1997).
Suzuki, et al. Structure of Bax: coregulation of dimer formation and intracellular localization. Cell. Nov. 10, 2000;103(4):645-54.
Tahir, et al. Influence of Bcl-2 family members on the cellular response of small-cell lung cancer cell lines to ABT-737. Cancer Res. Feb. 1, 2007;67(3):1176-83.
Thallinger, et al. Mcl-1 is a novel therapeutic target for human sarcoma: synergistic inhibition of human sarcoma xenotransplants by a combination of mc1-1 antisense oligonucleotides with low-dose cyclophosphamide. Clin. Cancer Res. Jun. 15, 2004;10(12 Pt 1):4185-91.
Walensky, et al. A stapled BID BH3 helix directly binds and activates BAX. Mol. Cell. Oct. 20, 2006;24(2):199-210.
Walensky, et al. Activation of apoptosis in vivo by a hydrocarbon-stapled BH3 helix. Science. Sep. 3, 2004;305(5689):1466-70.
Wang et al. Cell permeable Bcl-2 binding peptides: a chemical approach to apoptosis induction in tumor cells. Cancer Res. Mar. 15, 2000;60(6):1498-502.
Wei, et al. tBID, a membrane-targeted death ligand, oligomerizes BAK to release cytochrome c. Genes Dev. Aug. 15, 2000;14(16):2060-71.
Yang et al. Synthesis and helical structure of lactam bridged BH3 peptides derived from pro-apoptotic Bcl-2 family proteins. Bioorg Med Chem Lett. Mar. 22, 2004;14(6):1403-6.

(56) References Cited

OTHER PUBLICATIONS

Zamzami et al. The thiol crosslinking agent diamide overcomes the apoptosis-inhibitory effect of Bcl-2 by enforcing mitochondrial permeability transition. Oncogene. Feb. 26, 1998;16(8):1055-63.

Braun, et al. Photoreactive stapled BH3 peptides to dissect the BCL-2 family interactome. Chem Biol. Dec. 22, 2010;17(12):1325-33. doi: 10.1016/j.chembiol.2010.09.015.

Chittenden, et al. A conserved domain in Bak, distinct from BH1 and BH2, mediates cell death and protein binding functions. EMBO J. Nov. 15, 1995;14(22):5589-96.

Co-pending U.S. Appl. No. 15/794,355, filed Oct. 26, 2017.

Kelekar, et al. Bcl-2-family proteins: the role of the BH3 domain in apoptosis. Trends Cell Biol. Aug. 1998;8(8):324-30.

Leshchiner, et al. Direct activation of full-length proapoptotic BAK. PNAS, Mar. 12, 2013, vol. 110, No. 11, E986-E995.

O'Donnell, et al. Acute Myeloid Leukemia, Version 2.2013: Featured Updates to the NCCN Guidelines. Journal of the National Comprehensive Cancer Network : JNCCN. 2013;11(9):1047-1055.

Office action dated Nov. 24, 2017 for U.S. Appl. No. 15/135,098.

Thallinger, et al. Mcl-1 is a novel therapeutic target for human sarcoma: synergistic inhibition of human sarcoma xenotransplants by a combination of mcl-1 antisense oligonucleotides with low-dose cyclophosphamide. Clin Cancer Res. Jun. 15, 2004;10(12 Pt 1):4185-91.

Wang, et al. BID: a novel BH3 domain-only death agonist. Genes Dev. Nov. 15, 1996;10(22):2859-69.

PEPTIDOMIMETIC MACROCYCLES AS MODULATORS OF MCL-1

CROSS-REFERENCE

This application claims priority to U.S. Provisional Application No. 62/216,683, filed Sep. 10, 2015, which is incorporated herein by reference in their entirety.

SEQUENCE LISTING

The instant application contains a Sequence Listing which has been submitted electronically in ASCII format and is hereby incorporated by reference in its entirety. Said ASCII copy, created on Dec. 16, 2016, is named 35224-796_601_SL.TXT and is 1,592,888 bytes in size.

BACKGROUND OF THE INVENTION

Myeloid cell leukemia 1 (MCL-1) is a protein that inhibits cell death by binding and inhibiting pro-death factors, such as BCL-2 interacting mediator (BIM). When MCL-1 is over-expressed, the rate of cell death in a cell or tissue is reduced.

SUMMARY OF THE INVENTION

In some embodiments, the invention provides a peptidomimetic macrocycle of Formula (Ic):

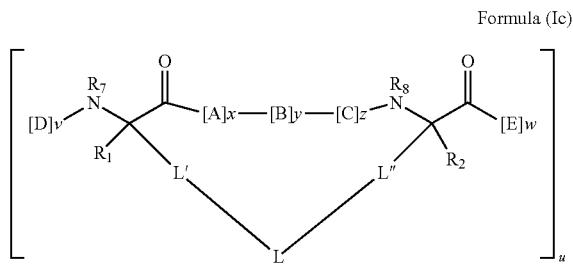

Formula (Ic)

wherein the peptidomimetic macrocycle binds MCL-1 selectively over another protein that has a BH3 domain, wherein:

each A, C, D, and E is independently a natural or non-natural amino acid;

each B is independently a natural or non-natural amino acid, amino acid analog,

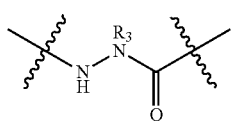

[—NH-$L_3$-CO—], [—NH-$L_3$-$SO_2$—], or [—NH-$L_3$-];

each L is independently a macrocycle-forming linker;

each L' is independently alkylene, alkenylene, alkynylene, heteroalkylene, cycloalkylene, heterocycloalkylene, arylene, or heteroarylene, each being optionally substituted with $R_5$, or a bond, or together with $R_1$ and the atom to which both $R_1$ and L' are bound forms a ring;

each L" is independently alkylene, alkenylene, alkynylene, cycloalkylene, heterocycloalkylene, arylene, or heteroarylene, each being optionally substituted with $R_5$, or a bond, or together with $R_2$ and the atom to which both $R_2$ and L" are bound forms a ring;

each $R_1$ is independently —H, alkyl, alkenyl, alkynyl, arylalkyl, cycloalkyl, cycloalkylalkyl, heteroalkyl, or heterocycloalkyl, unsubstituted or substituted with halo-, or together with L' and the atom to which both $R_1$ and L' are bound forms a ring;

each $R_2$ is independently —H, alkyl, alkenyl, alkynyl, arylalkyl, cycloalkyl, cycloalkylalkyl, heteroalkyl, or heterocycloalkyl, unsubstituted or substituted with halo-, or together with L" and the atom to which both $R_2$ and L" are bound forms a ring;

each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;

each $L_3$ is independently alkylene, alkenylene, alkynylene, heteroalkylene, cycloalkylene, heterocycloalkylene, arylene, heteroarylene, or [—$R_4$—K—$R_4$—]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each n is independently an integer from 1-5;

each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope, or a therapeutic agent;

each $R_6$ is independently —H, alkyl, alkenyl, alkynyl, arylalkyl, cycloalkylalkyl, heterocycloalkyl, a fluorescent moiety, a radioisotope, or a therapeutic agent;

each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

each $R_8$ is independently —H, alkyl, alkenyl, alkynyl, arylalkyl, cycloalkyl, cycloalkylalkyl, heteroalkyl, heterocycloalkyl, aryl, or heteroaryl, optionally substituted with $R_5$, or part of a cyclic structure with an E residue;

each v and w is independently an integer from 1-1000;

u is an integer from 1-10; and each x, y and z is independently an integer from 0-10, or a pharmaceutically-acceptable salt thereof.

In some embodiments, the invention provides a peptidomimetic macrocycle having the formula:

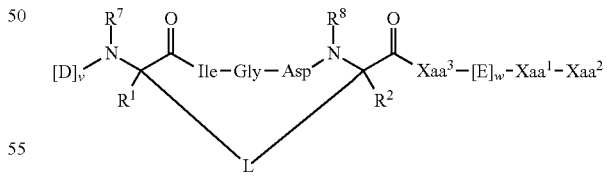

wherein:

each D and E is independently an amino acid residue;

$R^1$ and $R^2$ are independently alkyl, alkenyl, alkynyl, arylalkyl, cycloalkyl, cycloalkylalkyl, heteroalkyl, or heterocycloalkyl, each being optionally substituted with halo-; —H, or at least one of $R^1$ and $R^2$ forms a macrocycle-forming linker L' connected to the alpha position of one of the D or E amino acid residues;

L is a macrocycle-forming linker of the formula -$L^1$-$L^2$- or -$L^1$-$L^2$-$L^3$-;

each $L^1$, $L^2$, and $L^3$ is independently alkylene, alkenylene, alkynylene, heteroalkylene, cycloalkylene, heterocycloalkylene, arylene, heteroarylene, or $[-R^4-K-R^4-]_n$, each being optionally substituted with $R^5$;

each $R^3$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$;

each $R^4$ is independently alkylene, alkenylene, alkynylene, heteroalkylene, cycloalkylene, heterocycloalkylene, arylene, or heteroarylene, each being optionally substituted with $R^5$;

each K is independently O, S, SO, $SO_2$, CO, $CO_2$, or $CONR^3$;

each $R^5$ is independently halogen, alkyl, —$OR^6$, —$N(R^6)_2$, —$SR^6$, —$SOR^6$, —$SO_2R^6$, —$CO_2R^6$, a fluorescent moiety, a radioisotope, or a therapeutic agent;

each $R^6$ is independently —H, alkyl, alkenyl, alkynyl, arylalkyl, cycloalkylalkyl, heterocycloalkyl, a fluorescent moiety, a radioisotope, or a therapeutic agent;

$R^7$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with a D residue;

$R^8$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with an E residue;

each of $Xaa^1$ and $Xaa^2$ is independently an amino acid residue or absent;

$Xaa^3$ is Ala, Aib, Asp, Asn, Cys, Glu, Gln, His, Ile, Lys, Leu, Met, Arg, Ser, Thr, Val, Trp, Tyr, or an analog of any of the foregoing;

v is an integer from 1-1000;
w is an integer from 0-1000; and
n is an integer from 1-5, or
a pharmaceutically-acceptable salt thereof.

In some embodiments, the invention provides a peptidomimetic macrocycle of the formula (SEQ ID NO: 1783):

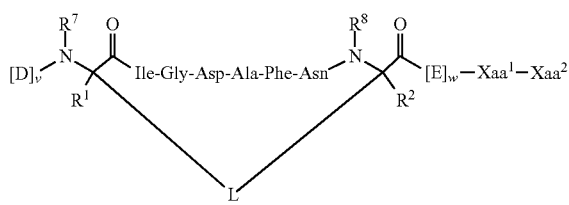

wherein:
each D and E is independently an amino acid residue;
$R^1$ and $R^2$ are independently alkyl, alkenyl, alkynyl, arylalkyl, cycloalkyl, cycloalkylalkyl, heteroalkyl, or heterocycloalkyl, each being optionally substituted with halo-; —H, or at least one of $R^1$ and $R^2$ forms a macrocycle-forming linker L' connected to the alpha position of one of the D or E amino acid residues;

each L or L' is independently a macrocycle-forming linker of the formula -$L^1$-$L^2$- or -$L^1$-$L^2$-$L^3$-;

each $L^1$, $L^2$, and $L^3$ is independently alkylene, alkenylene, alkynylene, heteroalkylene, cycloalkylene, heterocycloalkylene, arylene, heteroarylene, or $[-R^4-K-R^4-]_n$, each being optionally substituted with $R^5$;

each $R^3$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$;

each $R^4$ is independently alkylene, alkenylene, alkynylene, heteroalkylene, cycloalkylene, heterocycloalkylene, arylene, or heteroarylene, each being optionally substituted with $R^5$;

each K is independently O, S, SO, $SO_2$, CO, $CO_2$, or $CONR^3$;

each $R^5$ is independently halogen, alkyl, —$OR^6$, —$N(R^6)_2$, —$SR^6$, —$SOR^6$, —$SO_2R^6$, —$CO_2R^6$, a fluorescent moiety, a radioisotope, or a therapeutic agent;

each $R^6$ is independently —H, alkyl, alkenyl, alkynyl, arylalkyl, cycloalkylalkyl, heterocycloalkyl, a fluorescent moiety, a radioisotope, or a therapeutic agent;

$R^7$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with a D residue;

$R^8$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with an E residue;

each of $Xaa^1$ and $Xaa^2$ is independently an amino acid residue or absent;

v is an integer from 1-1000;
w is an integer from 0-1000; and
n is an integer from 1-5, or
a pharmaceutically-acceptable salt thereof.

In some embodiments, the invention provides a peptidomimetic macrocycle comprising an amino acid sequence of formula:

X1-X2-X3-X4-X5-X6-X7-X8-X9-X10-X11-X12-X13-X14-X15-X16-X17-X18-X19-X20-X21 wherein:
X1 is Ile, Arg, Ala, Lys, Pro, Leu, Asp, Glu, His, Ser, Gln, Phe, an analog thereof, or absent;

X2 is Trp, Arg, Ala, Asn, Phe, Pro, Leu, Ser, Lys, Tyr, His, Cou, Cou2, Cou4, Cou7, an analog thereof, a crosslinked amino acid, or absent;

X3 is Ile, Ala, Leu, Phe, Tyr, Val, Asp, Trp, Pro, Gln, Chg, Ac5c, Ac6c, Tba, Bip, Cha, Adm, hCha, an analog thereof, or absent;

X4 is Ala, Gln, Asp, Val, Gly, Ser, Leu, Phe, Cha, A4, an analog, thereof, a crosslinked amino acid, or absent;

X5 is Gln, Ala, Leu, Phe, Tyr, Gly, Ile, Val, Arg, Glu, Pro, Asp, MO, MO2, an analog thereof, a crosslinked amino acid, or absent;

X6 is Glu, Gln, His, Ala, Ser, Arg, Ile, Leu, Thr, Phe, Val, Tyr, Gly, Nle, St, an analog thereof, or absent;

X7 is Ala, Leu, Phe, Ile, 2Nal, 1Nal, 3cf, Chg, Cha, Adm, hCha, Igl, Bip, an analog thereof, or absent;

X8 is Arg, Ala, Asp, Glu, Thr, His, Gln, Gly, Asn, Phe, Cit, St, an analog thereof, a crosslinked amino acid, or absent;

X9 is Arg, Ala, Asp, Lys, Asn, Gly, Ser, Gln, Cys, Nle, St, an analog thereof, or a crosslinked amino acid;

X10 is Ile, Val, Ala, Asp, Asn, Phe, Tba, hL, hhL, Nle, Chg, Cha, an analog thereof, or a crosslinked amino acid;

X11 is Gly, Val, Ala, Leu, Ile, Asp, Glu, Cha, Aib, Abu, an analog thereof, or a crosslinked amino acid;

X12 is Asp, Ala, Asn, Gly, Arg, Glu, Lys, Leu, Nle, an analog thereof, or a crosslinked amino acid;

X13 is Ala, Glu, Gln, Leu, Lys, Asp, Tyr, Ile, Ser, Cys, St, Sta5, Aib, Nle, an analog thereof, or a crosslinked amino acid;

X14 is Phe, Ala, Leu, Val, Tyr, Glu, His, Ile, Nle, 1Nal, 2Nal, Chg, Cha, BiP, an analog thereof, or a crosslinked amino acid;

X15 is Asn, Gln, Ser, His, Glu, Asp, Ala, Leu, Ile, St, Nle, Aib, an analog thereof, a crosslinked amino acid, or absent;

X16 is Ala, Glu, Asp, Arg, Lys, Phe, Gly, Gin, Aib, Cha, St, an analog thereof, a crosslinked amino acid, or absent;

X17 is Phe, Tyr, Ala, Leu, Asn, Ser, Gin, Arg, His, Thr, Cou2, Cou3, Cou7, Dpr, Amf, Damf, Amye, an analog thereof, a crosslinked amino acid, or absent;

X18 is Tyr, Ala, Ile, Phe, His, Arg, Lys, Trp, Orn, Amf, Amye, Cha, 2Nal, an analog thereof, or absent;

X19 is Ala, Lys, Arg, His, Ser, Gin, Glu, Asp, Thr, Aib, Cha, an analog thereof, a crosslinked amino acid, or absent; and X20 is Arg, His, Ala, Thr, Lys, Amr, an analog thereof, a crosslinked amino acid, or absent; and X21 is Arg, His, Ala, Amr, an analog thereof, or absent, or a pharmaceutically-acceptable salt thereof, wherein at least two of the amino acids of the amino acid sequence are a crosslinked amino acid.

In some embodiments, the invention provides a peptidomimetic macrocycle comprising an amino acid sequence with C-terminal amino acid residues that are -His-His, wherein the peptidomimetic macrocycle comprises a crosslink connecting at least two amino acid residues, or a pharmaceutically-acceptable salt thereof.

In some embodiments, the invention provides a peptidomimetic macrocycle that comprises an amino acid sequence that has at least 60% identity to any one of SEQ ID NOs.: 1-1625.

INCORPORATION BY REFERENCE

All publications, patents, and patent applications mentioned in this specification are herein incorporated by reference in their entirety for all purposes, to the same extent as if each individual publication, patent, or patent application was specifically and individually indicated to be incorporated by reference.

DETAILED DESCRIPTION OF THE INVENTION

Figure 1:
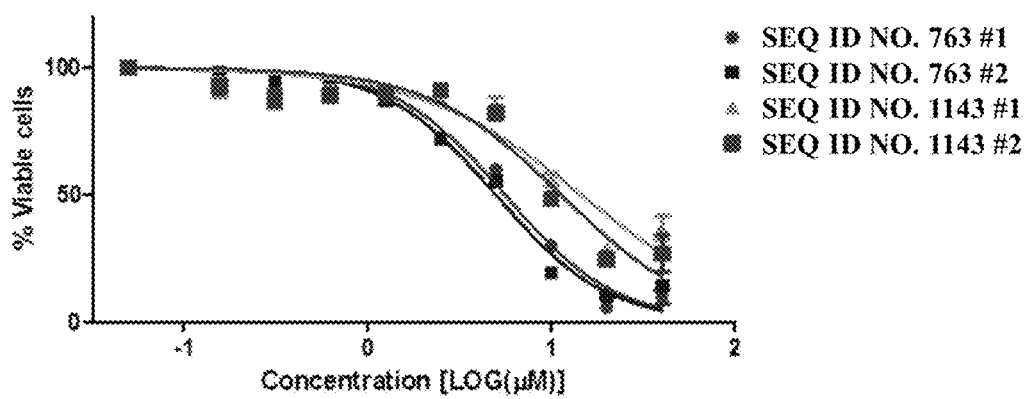
FIG. 1 illustrates cell viability over time after treatment with a peptidomimetic macrocycle.

The terminology used herein is for the purpose of describing particular cases only and is not intended to be limiting. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description or the claims, such terms are intended to be inclusive in a manner similar to the term "comprising".

The term "about" or "approximately" can mean within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, within 5-fold, and more preferably within 2-fold, of a value. Where particular values are described in the application and claims, unless otherwise stated the term "about" meaning within an acceptable error range for the particular value should be assumed. The term "about" has the meaning as commonly understood by one of ordinary skill in the art. In some embodiments, the term "about" refers to ±10%. In some embodiments, the term "about" refers to ±5%.

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analog) and a second naturally-occurring or non-naturally-occurring amino acid residue (or analog) within the same molecule. Peptidomimetic macrocycles include embodiments where the macrocycle-forming linker connects the α carbon of the first amino acid residue (or analog) to the α carbon of the second amino acid residue (or analog). The peptidomimetic macrocycles optionally include one or more non-peptide bonds between one or more amino acid residues or amino acid analog residues, and optionally include one or more non-naturally-occurring amino acid residues or amino acid analog residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

As used herein, the term "stability" refers to the maintenance of a defined secondary structure in solution by a peptidomimetic macrocycle of the invention as measured by circular dichroism, NMR or another biophysical measure, or resistance to proteolytic degradation in vitro or in vivo. Non-limiting examples of secondary structures contemplated in this invention are α-helices, $3_{10}$ helices, β-turns, and β-pleated sheets.

As used herein, the term "helical stability" refers to the maintenance of α helical structure by a peptidomimetic macrocycle of the invention as measured by circular dichroism or NMR. For example, in some embodiments, the peptidomimetic macrocycles of the invention exhibit at least a 1.25, 1.5, 1.75 or 2-fold increase in α-helicity as determined by circular dichroism compared to a corresponding uncrosslinked macrocycle.

The term "amino acid" refers to a molecule containing both an amino group and a carboxyl group. Suitable amino acids include, without limitation, both the D- and L-isomers of the naturally-occurring amino acids, as well as non-naturally occurring amino acids prepared by organic synthesis or other metabolic routes. The term amino acid, as used herein, includes without limitation, α-amino acids, natural amino acids, non-natural amino acids, and amino acid analogs.

The term "α-amino acid" refers to a molecule containing both an amino group and a carboxyl group bound to a carbon which is designated the α-carbon.

The term "β-amino acid" refers to a molecule containing both an amino group and a carboxyl group in a β configuration. The abbreviation "b-" prior to an amino acid represent a beta configuration for the amino acid.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The following Table shows a summary of the properties of natural amino acids:

The term "amino acid analog" refers to a molecule which is structurally similar to an amino acid and which can be substituted for an amino acid in the formation of a peptidomimetic macrocycle. Amino acid analogs include, without limitation, β-amino acids and amino acids where the amino or carboxy group is substituted by a similarly reactive group (e.g., substitution of the primary amine with a secondary or tertiary amine, or substitution of the carboxy group with an ester).

The term "non-natural amino acid" refers to an amino acid which is not one of the the twenty amino acids commonly found in peptides synthesized in nature, and known by the one letter abbreviations A, R, N, C, D, Q, E, G, H, I, L, K, M, F, P, S, T, W, Y and V. Non-natural amino

| Amino Acid | 3-Letter Code | 1-Letter Code | Side-chain Polarity | Side-chain charge (pH 7.4) | Hydropathy Index |
|---|---|---|---|---|---|
| Alanine | Ala | A | nonpolar | neutral | 1.8 |
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | polar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | positive (10%) neutral (90%) | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

"Hydrophobic amino acids" include small hydrophobic amino acids and large hydrophobic amino acids. "Small hydrophobic amino acids" are glycine, alanine, proline, and analogs thereof. "Large hydrophobic amino acids" are valine, leucine, isoleucine, phenylalanine, methionine, tryptophan, tyrosine, and analogs thereof. "Polar amino acids" are serine, threonine, asparagine, glutamine, cysteine, and analogs thereof. "Charged amino acids" include positively charged amino acids and negatively charged amino acids. "Positively charged amino acids" include lysine, arginine, histidine, and analogs thereof. "Negatively charged amino acids" include aspartate, glutamate, and analogs thereof.

acids or amino acid analogs include, without limitation, structures according to the following:

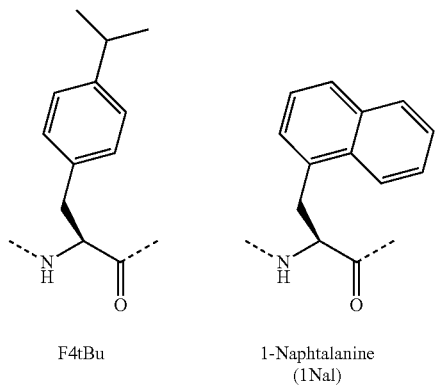

F4tBu

1-Naphtalanine (1Nal)

-continued
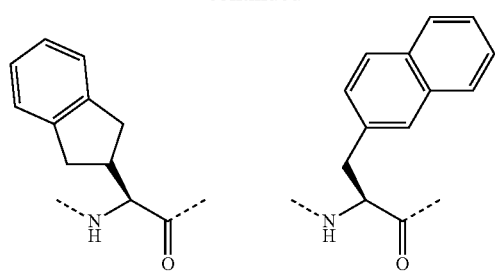
Indanyl glycine (Igl)　　2-Naphtalanine (2Nal)
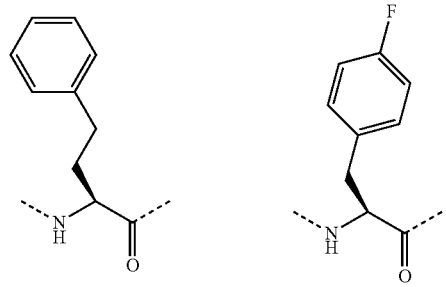
homophenylalanine (hF)　　F4F
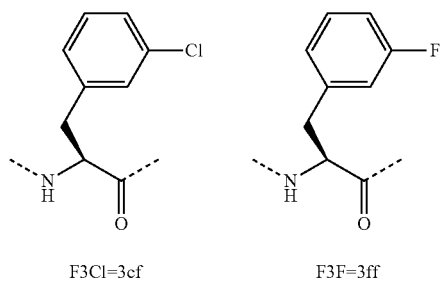
F3Cl=3cf　　F3F=3ff
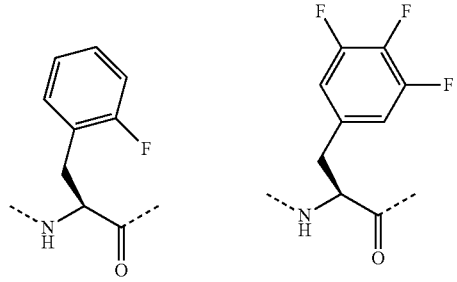
F2F=2ff　　F345F3
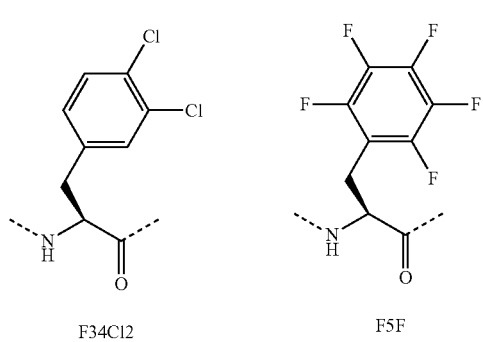
F34Cl2　　F5F
-continued
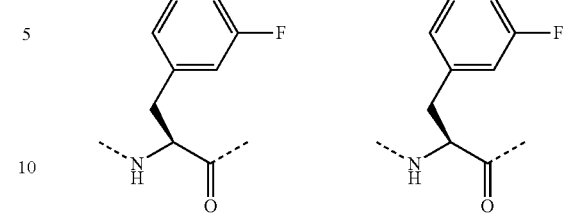
F34F2　　F35F2
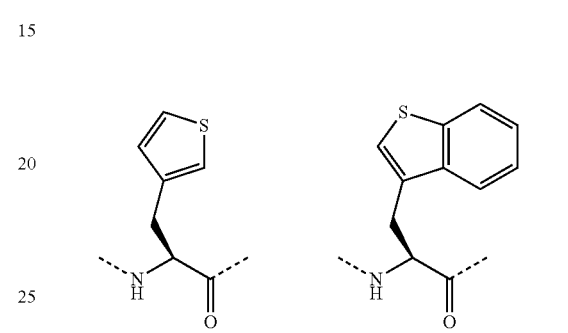
2Thi　　3BthA
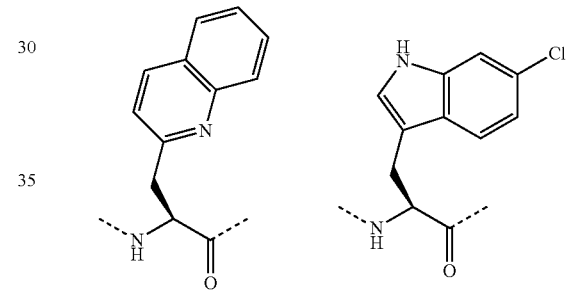
2qA　　6clW
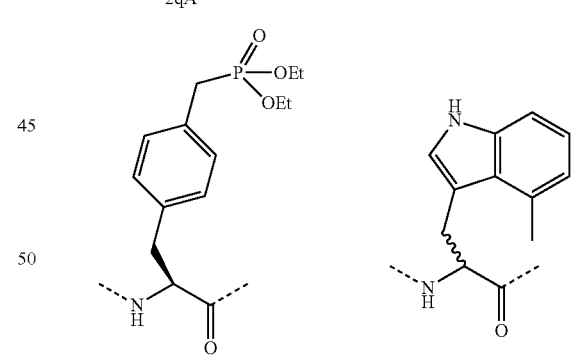
pmpEt　　dl4mW
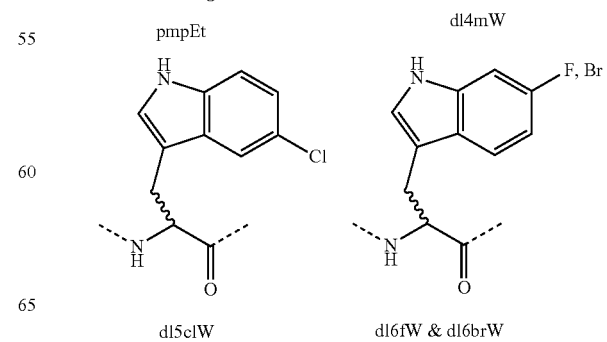
dl5clW　　dl6fW & dl6brW

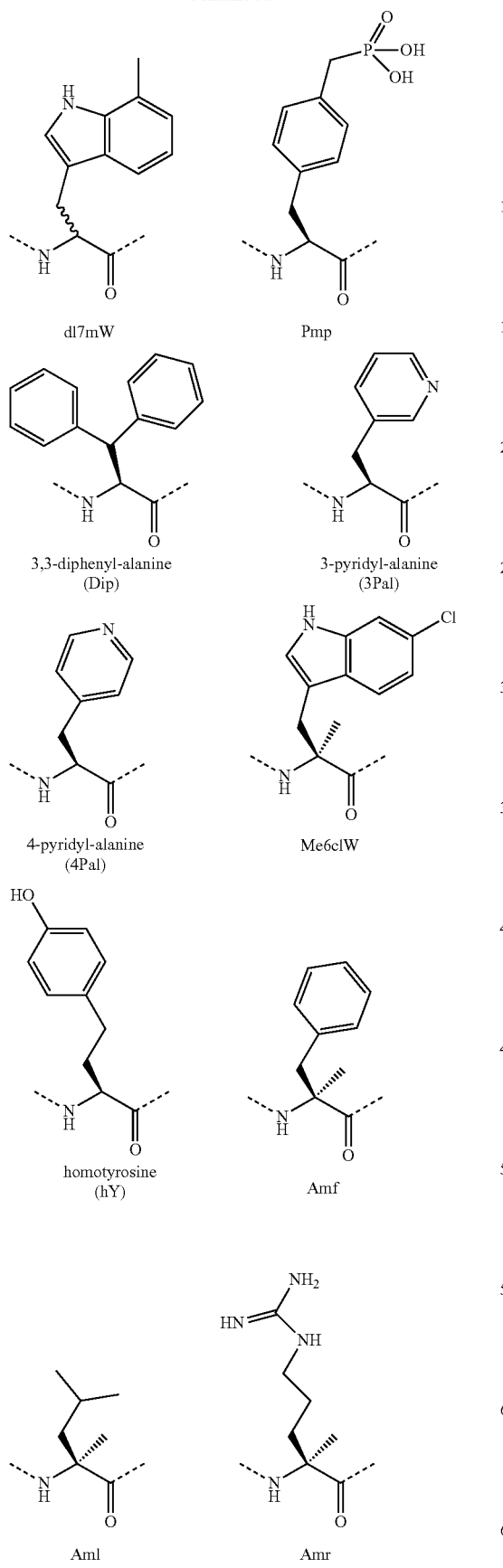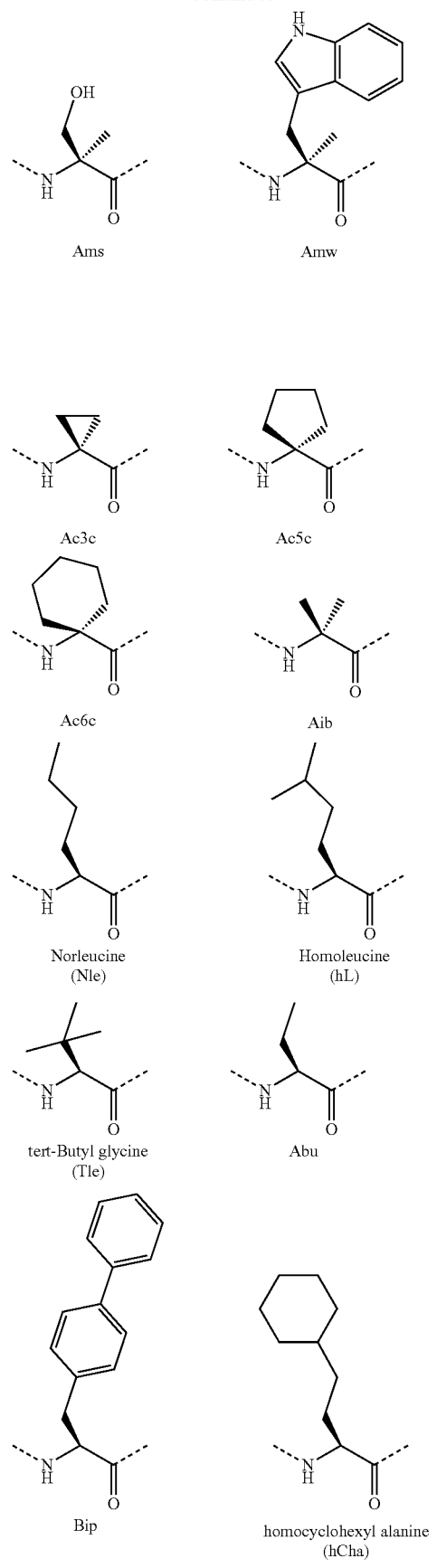

-continued
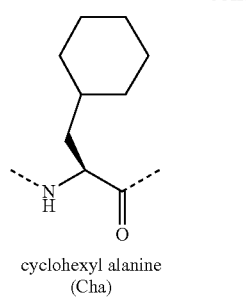
cyclohexyl alanine
(Cha)
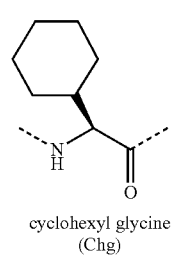
cyclohexyl glycine
(Chg)
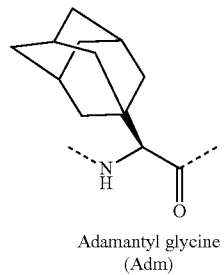
Adamantyl glycine
(Adm)
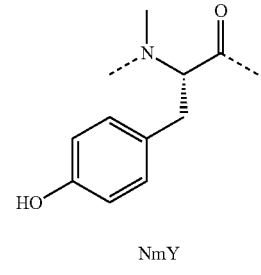
NmY
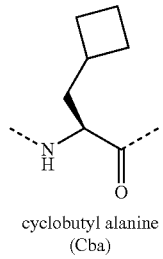
cyclobutyl alanine
(Cba)
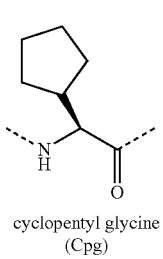
cyclopentyl glycine
(Cpg)
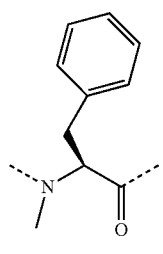
NmF
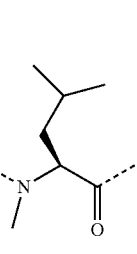
NmL
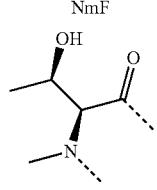
NmT
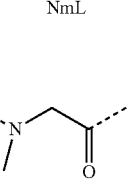
Sar
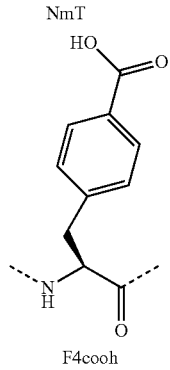
F4cooh
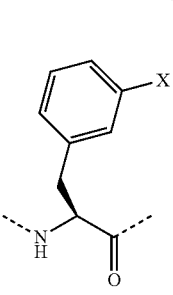
F2X
X=Cl, Br, CF3, CN, Me, NO2
-continued
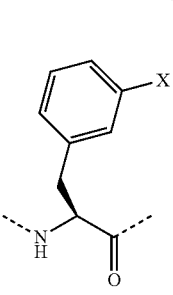
F3X
X=Cl, Br, CF3, CN, Me, NO2
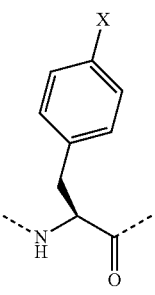
F4X
X=Cl, Br, CF3, CN, Me, NO2, I
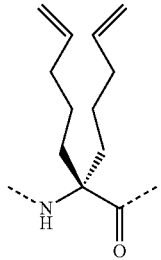
$St//$
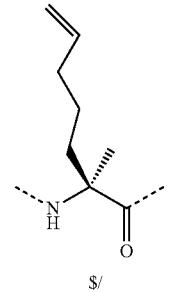
$/
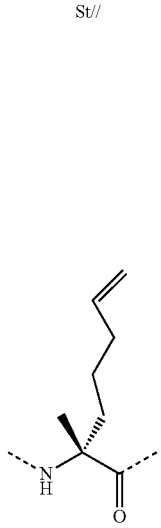
$/r5
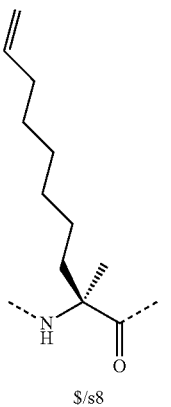
$/s8
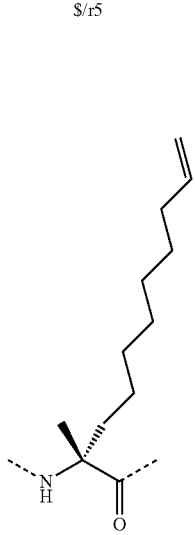
$/r8

-continued
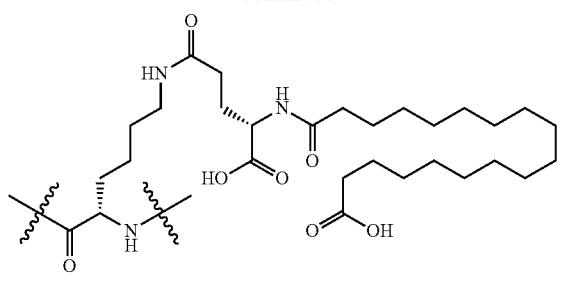
K(γ-Glu-C$_{18}$-dicarboxylic acid)
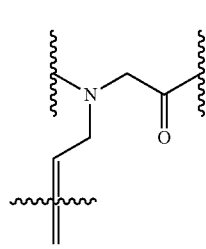
Gar
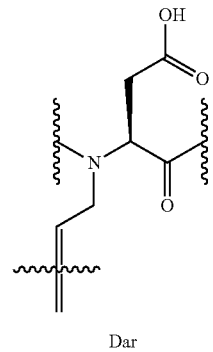
Dar
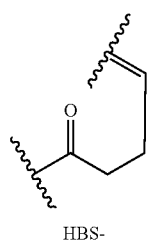
HBS-
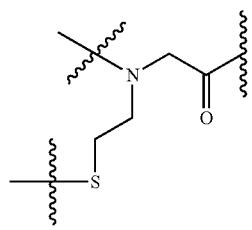
teGar
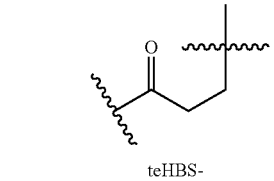
teHBS-
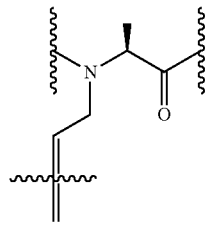
Aar
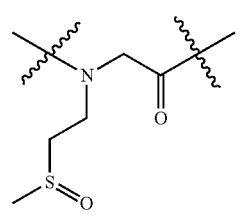
teOGar
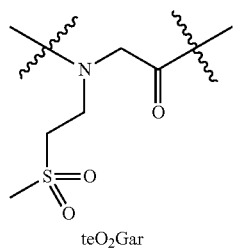
teO$_2$Gar
-continued
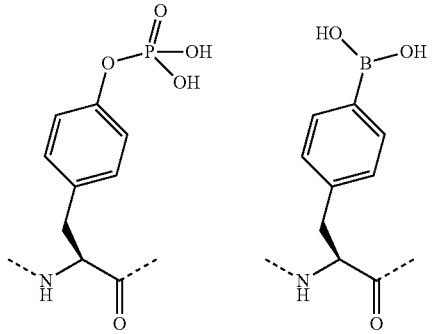
phosphotyrosine
(pY)
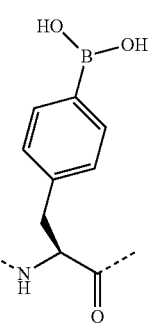
4-borono-
phenylalanine
(F4bOH2)
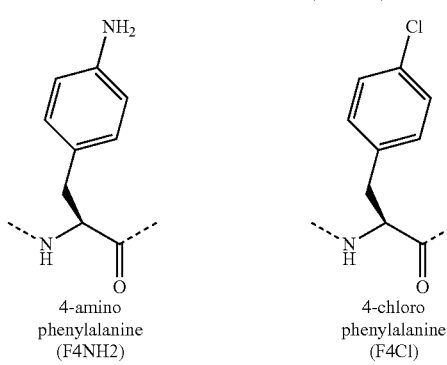
4-amino
phenylalanine
(F4NH2)
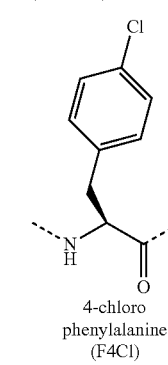
4-chloro
phenylalanine
(F4Cl)
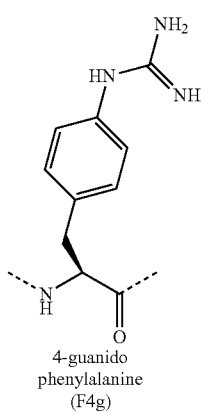
4-guanido
phenylalanine
(F4g)
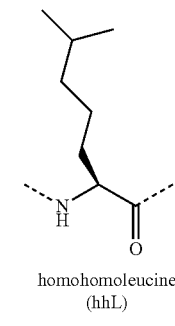
homohomoleucine
(hhL)
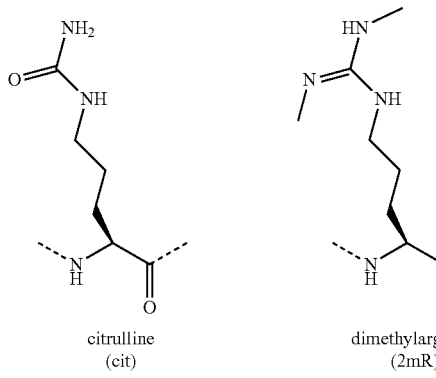
citrulline
(cit)
dimethylarginine
(2mR)

-continued

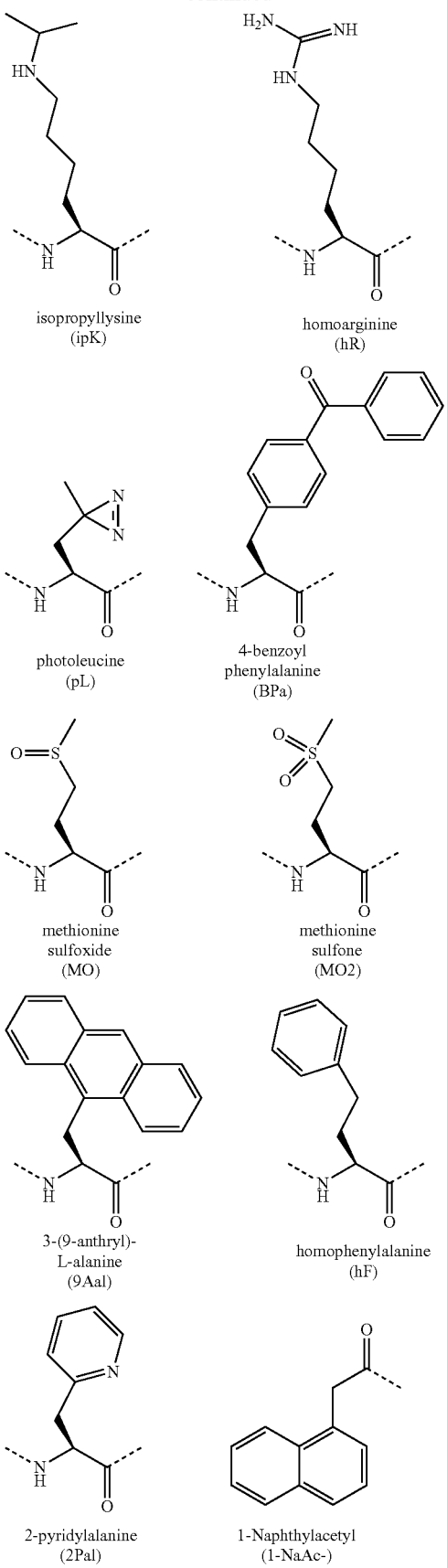

-continued

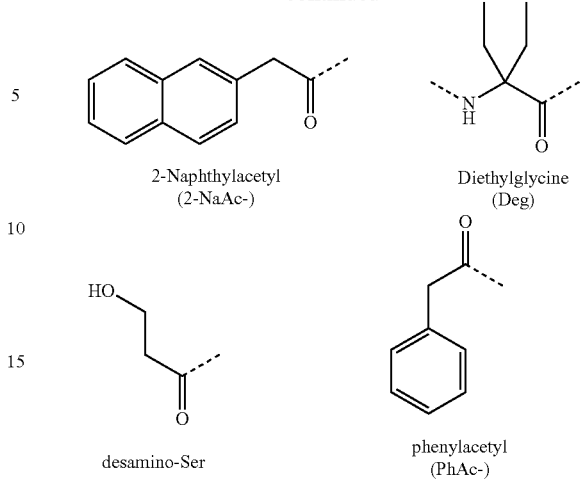

Amino acid analogs include β-amino acid analogs. Examples of β-amino acid analogs include, but are not limited to, the following: cyclic β-amino acid analogs; β-alanine; (R)-β-phenylalanine; (R)-1,2,3,4-tetrahydro-isoquinoline-3-acetic acid; (R)-3-amino-4-(1-naphthyl)-butyric acid; (R)-3-amino-4-(2,4-dichlorophenyl)butyric acid; (R)-3-amino-4-(2-chlorophenyl)-butyric acid; (R)-3-amino-4-(2-cyanophenyl)-butyric acid; (R)-3-amino-4-(2-fluorophenyl)-butyric acid; (R)-3-amino-4-(2-furyl)-butyric acid; (R)-3-amino-4-(2-methylphenyl)-butyric acid; (R)-3-amino-4-(2-naphthyl)-butyric acid; (R)-3-amino-4-(2-thienyl)-butyric acid; (R)-3-amino-4-(2-trifluoromethylphenyl)-butyric acid; (R)-3-amino-4-(3,4-dichlorophenyl)butyric acid; (R)-3-amino-4-(3,4-difluorophenyl)butyric acid; (R)-3-amino-4-(3-benzothienyl)-butyric acid; (R)-3-amino-4-(3-chlorophenyl)-butyric acid; (R)-3-amino-4-(3-cyanophenyl)-butyric acid; (R)-3-amino-4-(3-fluorophenyl)-butyric acid; (R)-3-amino-4-(3-methylphenyl)-butyric acid; (R)-3-amino-4-(3-pyridyl)-butyric acid; (R)-3-amino-4-(3-thienyl)-butyric acid; (R)-3-amino-4-(3-trifluoromethylphenyl)-butyric acid; (R)-3-amino-4-(4-bromophenyl)-butyric acid; (R)-3-amino-4-(4-chlorophenyl)-butyric acid; (R)-3-amino-4-(4-cyanophenyl)-butyric acid; (R)-3-amino-4-(4-fluorophenyl)-butyric acid; (R)-3-amino-4-(4-iodophenyl)-butyric acid; (R)-3-amino-4-(4-methylphenyl)-butyric acid; (R)-3-amino-4-(4-nitrophenyl)-butyric acid; (R)-3-amino-4-(4-pyridyl)-butyric acid; (R)-3-amino-4-(4-trifluoromethylphenyl)-butyric acid; (R)-3-amino-4-pentafluoro-phenylbutyric acid; (R)-3-amino-5-hexenoic acid; (R)-3-amino-5-hexynoic acid; (R)-3-amino-5-phenylpentanoic acid; (R)-3-amino-6-phenyl-5-hexenoic acid; (S)-1,2,3,4-tetrahydro-isoquinoline-3-acetic acid; (S)-3-amino-4-(1-naphthyl)-butyric acid; (S)-3-amino-4-(2,4-dichlorophenyl)butyric acid; (S)-3-amino-4-(2-chlorophenyl)-butyric acid; (S)-3-amino-4-(2-cyanophenyl)-butyric acid; (S)-3-amino-4-(2-fluorophenyl)-butyric acid; (S)-3-amino-4-(2-furyl)-butyric acid; (S)-3-amino-4-(2-methylphenyl)-butyric acid; (S)-3-amino-4-(2-naphthyl)-butyric acid; (S)-3-amino-4-(2-thienyl)-butyric acid; (S)-3-amino-4-(2-trifluoromethylphenyl)-butyric acid; (S)-3-amino-4-(3,4-dichlorophenyl)butyric acid; (S)-3-amino-4-(3,4-difluorophenyl)butyric acid; (S)-3-amino-4-(3-benzothienyl)-butyric acid; (S)-3-amino-4-(3-chlorophenyl)-butyric acid; (S)-3-amino-4-(3-cyanophenyl)-butyric acid; (S)-3-amino-4-(3-fluorophenyl)-butyric acid; (S)-3-amino-4-(3-methylphenyl)-butyric acid; (S)-3-amino-4-(3-pyridyl)-butyric acid; (S)-3-amino-4-(3-thienyl)-butyric acid; (S)-3-amino-4-(3-trifluoromethylphenyl)-butyric acid; (S)-3-amino-4-(4-bromophenyl)-butyric acid; (S)-3-amino-4-(4-chlorophenyl)-butyric acid; (S)-3-amino-4-(4-cyanophenyl)-butyric acid; (S)-3-amino-4-(4-fluorophenyl)-butyric acid; (S)-3-amino-4-(4-iodophenyl)-butyric acid; (S)-3-amino-4-(4-methylphenyl)-butyric acid; (S)-3-amino-4-(4-nitrophenyl)-butyric acid; (S)-3-amino-4-(4-pyridyl)-butyric acid; (S)-3-amino-4-(4-trifluoromethylphenyl)-butyric acid; (S)-3-amino-4-pentafluoro-phenylbutyric acid; (S)-3-amino-5-hexenoic acid; (S)-3-amino-5-hexynoic acid; (S)-3-amino-5-phenylpentanoic acid; (S)-3-amino-6-phenyl-5-hexenoic acid; 1,2,5,6-tetrahydropyridine-3-carboxylic acid; 1,2,5,6-tetrahydropyridine-4-carboxylic acid; 3-amino-3-(2-chlorophenyl)-propionic acid; 3-amino-3-(2-thienyl)-propionic acid; 3-amino-3-(3-bromophenyl)-propionic acid; 3-amino-3-(4-chlorophenyl)-propionic acid; 3-amino-3-(4-methoxyphenyl)-propionic acid; 3-amino-4,4,4-trifluoro-butyric acid; 3-aminoadipic acid; D-β-phenylalanine; β-leucine; L-β-homoalanine; L-β-homoaspartic acid γ-benzyl ester; L-β-homoglutamic acid δ-benzyl ester; L-β-homoisoleucine; L-β-homoleucine; L-β-homomethionine; L-β-homophenylalanine; L-β-homoproline; L-β-homotryptophan; L-β-homovaline; L-Nω-benzyloxycarbonyl-β-homolysine; Nω-L-β-homoarginine; O-benzyl-L-β-homohydroxyproline; O-benzyl-L-β-homoserine; O-benzyl-L-β-homothreonine; O-benzyl-L-β-homotyrosine; γ-trityl-L-β-homoasparagine; (R)-β-phenylalanine; L-β-homoaspartic acid γ-t-butyl ester; L-β-homoglutamic acid δ-t-butyl ester; L-Nω-β-homolysine; Nδ-trityl-L-β-homoglutamine; Nω-2,2,4,6,7-pentamethyl-dihydrobenzofuran-5-sulfonyl-L-β-homoarginine; O-t-butyl-L-β-homohydroxy-proline; O-t-butyl-L-β-homoserine; O-t-butyl-L-β-homothreonine; O-t-butyl-L-β-homotyrosine; 2-aminocyclopentane carboxylic acid; and 2-aminocyclohexane carboxylic acid.

Amino acid analogs include analogs of alanine, valine, glycine or leucine. Examples of amino acid analogs of alanine, valine, glycine, and leucine include, but are not limited to, the following: α-methoxyglycine; α-allyl-L-alanine; α-aminoisobutyric acid; α-methyl-leucine; β-(1-naphthyl)-D-alanine; β-(1-naphthyl)-L-alanine; β-(2-naphthyl)-D-alanine; β-(2-naphthyl)-L-alanine; β-(2-pyridyl)-D-alanine; β-(2-pyridyl)-L-alanine; β-(2-thienyl)-D-alanine; β-(2-thienyl)-L-alanine; β-(3-benzothienyl)-D-alanine; β-(3-benzothienyl)-L-alanine; β-(3-pyridyl)-D-alanine; β-(3-pyridyl)-L-alanine; β-(4-pyridyl)-D-alanine; β-(4-pyridyl)-L-alanine; β-chloro-L-alanine; β-cyano-L-alanin; β-cyclohexyl-D-alanine; β-cyclohexyl-L-alanine; β-cyclopenten-1-yl-alanine; β-cyclopentyl-alanine; β-cyclopropyl-L-Ala-OH.dicyclohexylammonium salt; β-t-butyl-D-alanine; β-t-butyl-L-alanine; γ-aminobutyric acid; L-α,β-diaminopropionic acid; 2,4-dinitro-phenylglycine; 2,5-dihydro-D-phenylglycine; 2-amino-4,4,4-trifluorobutyric acid; 2-fluoro-phenylglycine; 3-amino-4,4,4-trifluoro-butyric acid; 3-fluoro-valine; 4,4,4-trifluoro-valine; 4,5-dehydro-L-leu-OH.dicyclohexylammonium salt; 4-fluoro-D-phenylglycine; 4-fluoro-L-phenylglycine; 4-hydroxy-D-phenylglycine; 5,5,5-trifluoro-leucine; 6-aminohexanoic acid; cyclopentyl-D-Gly-OH.dicyclohexylammonium salt; cyclopentyl-Gly-OH.dicyclohexylammonium salt; D-α,β-diaminopropionic acid; D-α-aminobutyric acid; D-α-t-butylglycine; D-(2-thienyl)glycine; D-(3-thienyl)glycine; D-2-aminocaproic acid; D-2-indanylglycine; D-allylglycine-dicyclohexylammonium salt; D-cyclohexylglycine; D-norvaline; D-phenylglycine; β-aminobutyric acid; β-aminoisobutyric acid; (2-bromophenyl)glycine; (2-methoxyphenyl)glycine; (2-methylphenyl)glycine; (2-thiazoyl)glycine; (2-thienyl)glycine; 2-amino-3-(dimethylamino)-propionic acid; L-α,β-diaminopropionic acid; L-α-aminobutyric acid; L-α-t-butylglycine; L-(3-thienyl)glycine; L-2-amino-3-(dimethylamino)-propionic acid; L-2-aminocaproic acid dicyclohexyl-ammonium salt; L-2-indanylglycine; L-allylglycine-dicyclohexyl ammonium salt; L-cyclohexylglycine; L-phenylglycine; L-propargyl-glycine; L-norvaline; N-α-aminomethyl-L-alanine; D-α,γ-diaminobutyric acid; L-α,γ-diaminobutyric acid; β-cyclopropyl-L-alanine; (N-β-(2,4-dinitrophenyl))-L-α,β-diaminopropionic acid; (N-β-1-(4,4-dimethyl-2,6-dioxocyclohex-1-ylidene)ethyl)-D-α,β-diaminopropionic acid; (N-β-1-(4,4-dimethyl-2,6-dioxocyclohex-1-ylidene)ethyl)-L-α,β-diaminopropionic acid; (N-β-4-methyltrityl)-L-α,β-diaminopropionic acid; (N-β-allyloxycarbonyl)-L-α,β-diaminopropionic acid; (N-γ-1-(4,4-dimethyl-2,6-dioxocyclohex-1-ylidene)ethyl)-D-α,γ-diaminobutyric acid; (N-γ-1-(4,4-dimethyl-2,6-dioxocyclohex-1-ylidene)ethyl)-L-α,γ-diaminobutyric acid; (N-γ-4-methyltrityl)-D-α,γ-diaminobutyric acid; (N-γ-4-methyltrityl)-L-α,γ-diaminobutyric acid; (N-γ-allyloxycarbonyl)-L-α,γ-diaminobutyric acid; D-α,γ-diaminobutyric acid; 4,5-dehydro-L-leucine; cyclopentyl-D-Gly-OH; cyclopentyl-Gly-OH; D-allylglycine; D-homocyclohexylalanine; L-1-pyrenylalanine; L-2-aminocaproic acid; L-allylglycine; L-homocyclohexylalanine; and N-(2-hydroxy-4-methoxy-Bzl)-Gly-OH.

Amino acid analogs include analogs of arginine or lysine. Examples of amino acid analogs of arginine and lysine include, but are not limited to, the following: citrulline; L-2-amino-3-guanidinopropionic acid; L-2-amino-3-ureido-propionic acid; L-citrulline; Lys(Me)$_2$-OH; Lys(N$_3$)—OH; Nδ-benzyloxycarbonyl-L-ornithine; Nω-nitro-D-arginine; Nω-nitro-L-arginine; α-methyl-ornithine; 2,6-diaminoheptanedioic acid; L-ornithine; (Nδ-1-(4,4-dimethyl-2,6-dioxocyclohex-1-ylidene)ethyl)-D-ornithine; (Nδ-1-(4,4-dimethyl-2,6-dioxo-cyclohex-1-ylidene)ethyl)-L-ornithine; (Nδ-4-methyltrityl)-D-ornithine; (Nδ-4-methyltrityl)-L-ornithine; D-ornithine; L-ornithine; Arg(Me)(Pbf)-OH; Arg(Me)$_2$-OH (asymmetrical); Arg(Me)2-OH (symmetrical); Lys(ivDde)-OH; Lys(Me)2-OH.HCl; Lys(Me3)-OH chloride; Nω-nitro-D-arginine; and Nω-nitro-L-arginine.

Amino acid analogs include analogs of aspartic or glutamic acids. Examples of amino acid analogs of aspartic and glutamic acids include, but are not limited to, the following: α-methyl-D-aspartic acid; α-methyl-glutamic acid; α-methyl-L-aspartic acid; γ-methylene-glutamic acid; (N-γ-ethyl)-L-glutamine; [N-α-(4-aminobenzoyl)]-L-glutamic acid; 2,6-diaminopimelic acid; L-α-aminosuberic acid; D-2-aminoadipic acid; D-α-aminosuberic acid; α-aminopimelic acid; iminodiacetic acid; L-2-aminoadipic acid; threo-β-methyl-aspartic acid; γ-carboxy-D-glutamic acid γ,γ-di-t-butyl ester; γ-carboxy-L-glutamic acid γ,γ-di-t-butyl ester; Glu(OAll)-OH; L-Asu(OtBu)-OH; and pyroglutamic acid.

Amino acid analogs include analogs of cysteine and methionine. Examples of amino acid analogs of cysteine and methionine include, but are not limited to, Cys(farnesyl)-OH, Cys(farnesyl)-OMe, α-methyl-methionine, Cys(2-hydroxyethyl)-OH, Cys(3-aminopropyl)-OH, 2-amino-4-(ethylthio)butyric acid, buthionine, buthioninesulfoximine, ethionine, methionine methylsulfonium chloride, selenomethionine, cysteic acid, [2-(4-pyridyl)ethyl]-DL-penicillamine, [2-(4-pyridyl)ethyl]-L-cysteine, 4-methoxybenzyl-D-penicillamine, 4-methoxybenzyl-L-penicillamine, 4-methylbenzyl-D-penicillamine, 4-methylbenzyl-L-penicillamine, benzyl-D-cysteine, benzyl-L-cysteine, benzyl-DL-homocysteine, carbamoyl-L-cysteine, carboxyethyl-L-cysteine, carboxymethyl-L-cysteine, diphenylmethyl-L-cysteine, ethyl-L-cysteine, methyl-L-cysteine, t-butyl-D- cysteine, trityl-L-homocysteine, trityl-D-penicillamine, cystathionine, homocystine, L-homocystine, (2-aminoethyl)-L-cysteine, seleno-L-cystine, cystathionine, Cys(StBu)-OH, and acetamidomethyl-D-penicillamine.

Amino acid analogs include analogs of phenylalanine and tyrosine. Examples of amino acid analogs of phenylalanine and tyrosine include β-methyl-phenylalanine, β-hydroxy-phenylalanine, α-methyl-3-methoxy-DL-phenylalanine, α-methyl-D-phenylalanine, α-methyl-L-phenylalanine, 1,2,3,4-tetrahydroisoquinoline-3-carboxylic acid, 2,4-dichloro-phenylalanine, 2-(trifluoromethyl)-D-phenylalanine, 2-(trifluoromethyl)-L-phenylalanine, 2-bromo-D-phenylalanine, 2-bromo-L-phenylalanine, 2-chloro-D-phenylalanine, 2-chloro-L-phenylalanine, 2-cyano-D-phenylalanine, 2-cyano-L-phenylalanine, 2-fluoro-D-phenylalanine, 2-fluoro-L-phenylalanine, 2-methyl-D-phenylalanine, 2-methyl-L-phenylalanine, 2-nitro-D-phenylalanine, 2-nitro-L-phenylalanine, 2;4;5-trihydroxy-phenylalanine, 3,4,5-trifluoro-D-phenylalanine, 3,4,5-trifluoro-L-phenylalanine, 3,4-dichloro-D-phenylalanine, 3,4-dichloro-L-phenylalanine, 3,4-difluoro-D-phenylalanine, 3,4-difluoro-L-phenylalanine, 3,4-dihydroxy-L-phenylalanine, 3,4-dimethoxy-L-phenylalanine, 3,5,3'-triiodo-L-thyronine, 3,5-diiodo-D-tyrosine, 3,5-diiodo-L-tyrosine, 3,5-diiodo-L-thyronine, 3-(trifluoromethyl)-D-phenylalanine, 3-(trifluoromethyl)-L-phenylalanine, 3-amino-L-tyrosine, 3-bromo-D-phenylalanine, 3-bromo-L-phenylalanine, 3-chloro-D-phenylalanine, 3-chloro-L-phenylalanine, 3-chloro-L-tyrosine, 3-cyano-D-phenylalanine, 3-cyano-L-phenylalanine, 3-fluoro-D-phenylalanine, 3-fluoro-L-phenylalanine, 3-fluoro-tyrosine, 3-iodo-D-phenylalanine, 3-iodo-L-phenylalanine, 3-iodo-L-tyrosine, 3-methoxy-L-tyrosine, 3-methyl-D-phenylalanine, 3-methyl-L-phenylalanine, 3-nitro-D-phenylalanine, 3-nitro-L-phenylalanine, 3-nitro-L-tyrosine, 4-(trifluoromethyl)-D-phenylalanine, 4-(trifluoromethyl)-L-phenylalanine, 4-amino-D-phenylalanine, 4-amino-L-phenylalanine, 4-benzoyl-D-phenylalanine, 4-benzoyl-L-phenylalanine, 4-bis(2-chloroethyl)amino-L-phenylalanine, 4-bromo-D-phenylalanine, 4-bromo-L-phenylalanine, 4-chloro-D-phenylalanine, 4-chloro-L-phenylalanine, 4-cyano-D-phenylalanine, 4-cyano-L-phenylalanine, 4-fluoro-D-phenylalanine, 4-fluoro-L-phenylalanine, 4-iodo-D-phenylalanine, 4-iodo-L-phenylalanine, homophenylalanine, thyroxine, 3,3-diphenylalanine, thyronine, ethyl-tyrosine, and methyl-tyrosine.

Amino acid analogs include analogs of proline. Examples of amino acid analogs of proline include, but are not limited to, 3,4-dehydro-proline, 4-fluoro-proline, cis-4-hydroxy-proline, thiazolidine-2-carboxylic acid, and trans-4-fluoro-proline.

Amino acid analogs include analogs of serine and threonine. Examples of amino acid analogs of serine and threonine include, but are not limited to, 3-amino-2-hydroxy-5-methylhexanoic acid, 2-amino-3-hydroxy-4-methylpentanoic acid, 2-amino-3-ethoxybutanoic acid, 2-amino-3-methoxybutanoic acid, 4-amino-3-hydroxy-6-methylheptanoic acid, 2-amino-3-benzyloxypropionic acid, 2-amino-3-benzyloxypropionic acid, 2-amino-3-ethoxypropionic acid, 4-amino-3-hydroxybutanoic acid, and α-methylserine.

Amino acid analogs include analogs of tryptophan. Examples of amino acid analogs of tryptophan include, but are not limited to, the following: α-methyl-tryptophan; β-(3-benzothienyl)-D-alanine; β-(3-benzothienyl)-L-alanine; 1-methyl-tryptophan; 4-methyl-tryptophan; 5-benzyloxy-tryptophan; 5-bromo-tryptophan; 5-chloro-tryptophan; 5-fluoro-tryptophan; 5-hydroxy-tryptophan; 5-hydroxy-L-tryptophan; 5-methoxy-tryptophan; 5-methoxy-L-tryptophan; 5-methyl-tryptophan; 6-bromo-tryptophan; 6-chloro-D-tryptophan; 6-chloro-tryptophan; 6-fluoro-tryptophan; 6-methyl-tryptophan; 7-benzyloxy-tryptophan; 7-bromo-tryptophan; 7-methyl-tryptophan; D-1,2,3,4-tetrahydro-norharman-3-carboxylic acid; 6-methoxy-1,2,3,4-tetrahydronorharman-1-carboxylic acid; 7-azatryptophan; L-1,2,3,4-tetrahydro-norharman-3-carboxylic acid; 5-methoxy-2-methyl-tryptophan; and 6-chloro-L-tryptophan.

In some embodiments, amino acid analogs are racemic. In some embodiments, the D isomer of the amino acid analog is used. In some embodiments, the L isomer of the amino acid analog is used. In other embodiments, the amino acid analog comprises chiral centers that are in the R or S configuration. In still other embodiments, the amino group(s) of a β-amino acid analog is substituted with a protecting group, e.g., tert-butyloxycarbonyl (BOC group), 9-fluorenylmethyloxycarbonyl (FMOC), tosyl, and the like. In yet other embodiments, the carboxylic acid functional group of a β-amino acid analog is protected, e.g., as its ester derivative. In some embodiments the salt of the amino acid analog is used.

A "non-essential" amino acid residue is a residue that can be altered from the wild-type sequence of a polypeptide without abolishing or substantially abolishing its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, for example, is replaced with another amino acid residue from the same side chain family. Other examples of acceptable substitutions are substitutions based on isosteric considerations (e.g. norleucine for methionine) or other properties (e.g. 2-thienylalanine for phenylalanine).

The term "capping group" refers to the chemical moiety occurring at either the carboxy or amino terminus of the polypeptide chain of the subject peptidomimetic macrocycle. The capping group of a carboxy terminus includes an unmodified carboxylic acid (ie —COOH) or a carboxylic acid with a substituent. For example, the carboxy terminus can be substituted with an amino group to yield a carboxamide at the C-terminus. Various substituents include but are not limited to primary and secondary amines, including pegylated secondary amines. Non-limiting representative secondary amine capping groups for the C-terminus include:

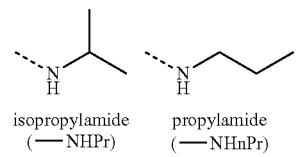

isopropylamide (—NHPr)  propylamide (—NHnPr)

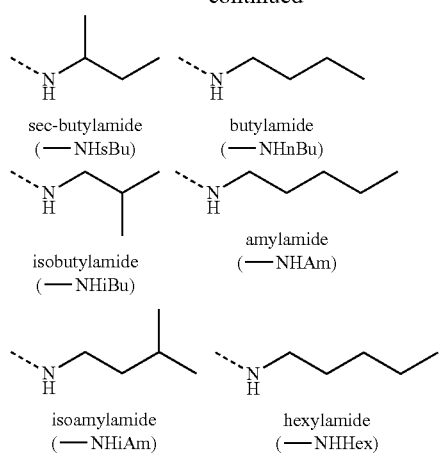
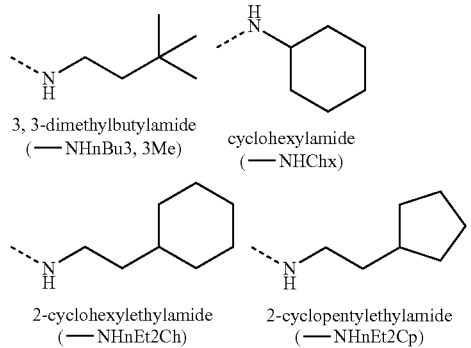
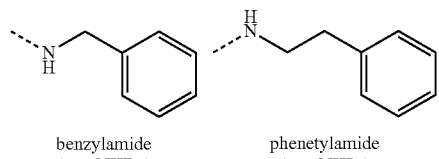
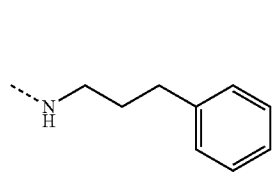
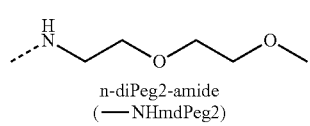

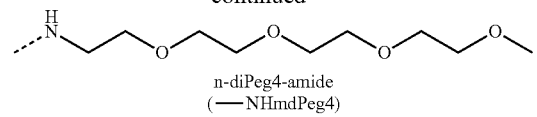
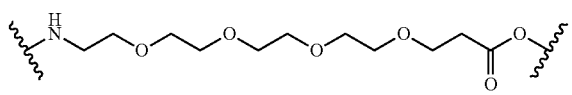
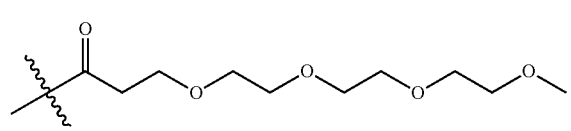
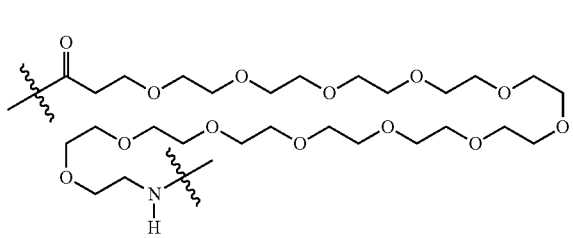
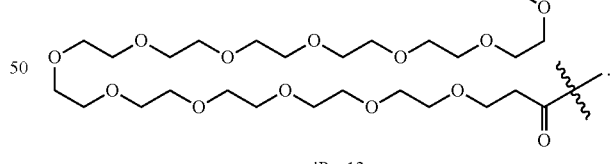

The capping group of an amino terminus includes an unmodified amine (ie —NH$_2$) or an amine with a substituent. For example, the amino terminus can be substituted with an acyl group to yield a carboxamide at the N-terminus. Various substituents include but are not limited to substituted acyl groups, including $C_1$-$C_6$ carbonyls, $C_7$-$C_{30}$ carbonyls, and pegylated carbamates. Non-limiting representative capping groups for the N-terminus include:

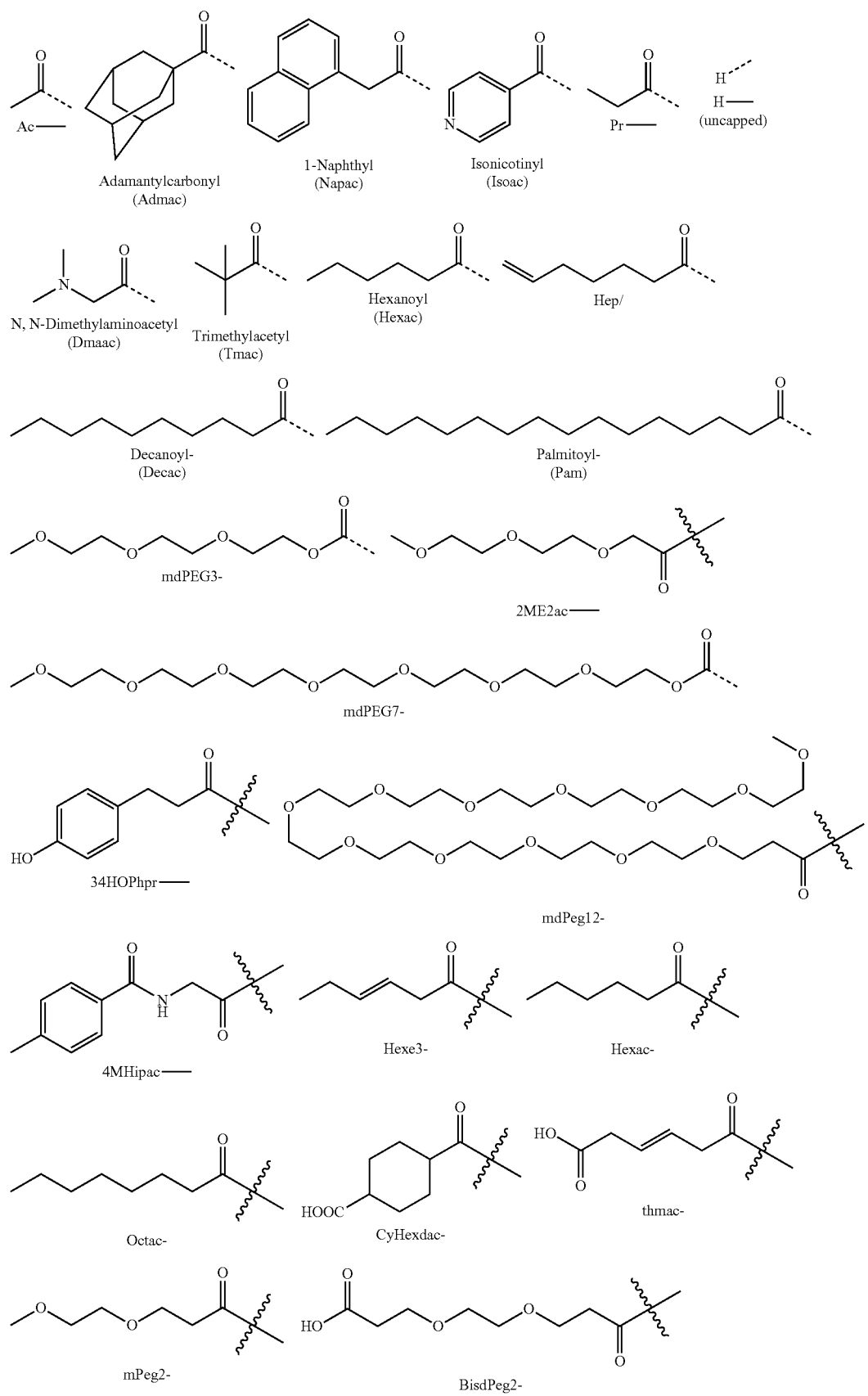

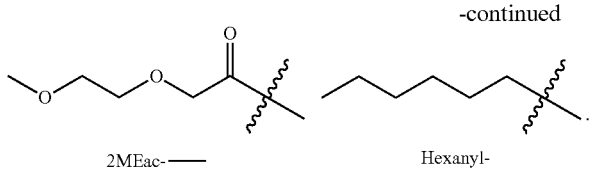

2MEac-——   Hexanyl-

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⌇" when used as part of a molecular structure refers to a single bond or a trans or cis double bond.

The term "amino acid side chain" refers to a moiety attached to the α-carbon (or another backbone atom) in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,α di-substituted amino acid).

The term "α,α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "macrocyclization reagent" or "macrocycle-forming reagent" as used herein refers to any reagent which may be used to prepare a peptidomimetic macrocycle of the invention by mediating the reaction between two reactive groups. Reactive groups may be, for example, an azide and alkyne, in which case macrocyclization reagents include, without limitation, Cu reagents such as reagents which provide a reactive Cu(I) species, such as CuBr, CuI or CuOTf, as well as Cu(II) salts such as Cu(CO$_2$CH$_3$)$_2$, CuSO$_4$, and CuCl$_2$ that can be converted in situ to an active Cu(I) reagent by the addition of a reducing agent such as ascorbic acid or sodium ascorbate. Macrocyclization reagents may additionally include, for example, Ru reagents known in the art such as Cp*RuCl(PPh$_3$)$_2$, [Cp*RuCl]$_4$ or other Ru reagents which may provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. In other examples, catalysts have W or Mo centers. Various catalysts are disclosed in Grubbs et al., "Ring Closing Metathesis and Related Processes in Organic Synthesis" Acc. Chem. Res. 1995, 28, 446-452, and U.S. Pat. No. 5,811,515; U.S. Pat. No. 7,932, 397; U.S. Application No. 2011/0065915; U.S. Application No. 2011/0245477; Yu et al., "Synthesis of Macrocyclic Natural Products by Catalyst-Controlled Stereoselective Ring-Closing Metathesis," Nature 2011, 479, 88; and Peryshkov et al., "Z-Selective Olefin Metathesis Reactions Promoted by Tungsten Oxo Alkylidene Complexes," J. Am. Chem. Soc. 2011, 133, 20754. In yet other cases, the reactive groups are thiol groups. In such embodiments, the macrocyclization reagent is, for example, a linker functionalized with two thiol-reactive groups such as halogen groups.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a monocyclic or bicyclic aromatic ring system wherein 0, 1, 2, 3, or 4 atoms of each ring are substituted by a substituent. Examples of aryl groups include phenyl, biphenyl, naphthyl and the like. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH2-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl.

"Alkylheterocycle" refers to a C$_1$-C$_5$ alkyl group, as defined above, wherein one of the C$_1$-C$_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a C$_1$-C$_5$ alkyl group, as defined above, wherein one of the C$_1$-C$_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH3, and —CH$_2$—CH$_2$—NH—C(O)—CH=CH$_2$.

"Alkanol" refers to a C$_1$-C$_5$ alkyl group, as defined above, wherein one of the C$_1$-C$_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a C$_1$-C$_5$ alkyl group, as defined above, wherein one of the C$_1$-C$_5$ alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds of this invention contain one or more asymmetric centers and thus occur as racemates and racemic mixtures, single enantiomers, individual diastereomers and diastereomeric mixtures. All such isomeric forms of these compounds are included in the present invention unless expressly provided otherwise. In some embodiments, the compounds of this invention are also represented in multiple tautomeric forms, in such instances, the invention includes all tautomeric forms of the compounds described herein (e.g., if alkylation of a ring system results in alkylation at multiple sites, the invention includes all such reaction products). All such isomeric forms of such compounds are included in the present invention unless expressly provided otherwise. All crystal forms of the compounds described herein are included in the present invention unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the variable is equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "or" and not the exclusive sense of "either/or."

The term "on average" represents the mean value derived from performing at least three independent replicates for each data point.

The term "biological activity" encompasses structural and functional properties of a macrocycle of the invention. Biological activity is, for example, structural stability, alpha-helicity, affinity for a target, resistance to proteolytic degradation, cell penetrability, intracellular stability, in vivo stability, or any combination thereof.

The details of one or more particular embodiments of the invention are set forth in the accompanying drawings and the description below. Other features, objects, and advantages of the invention will be apparent from the description and drawings, and from the claims.

Peptidomimetic Macrocycles of the Invention

The present invention provides pharmaceutical formulations comprising an effective amount of peptidomimetic macrocycles or pharmaceutically acceptable salts thereof. The peptidomimetic macrocycles of the invention are cross-linked (e.g., stapled or stitched) and possess improved pharmaceutical properties relative to their corresponding uncross-linked peptidomimetic macrocycles. These improved properties include improved bioavailability, enhanced chemical and in vivo stability, increased potency, and reduced immunogenicity (i.e., fewer or less severe injection site reactions).

In some embodiments, the peptide sequences are derived from BIM.

In some embodiments, a peptidomimetic macrocycle peptide derived from a human BIM peptide can be a peptide comprising 1, 2, 3, 4, 5, 6, 7, 8, 9, 10, 11, 12, 13, 14, 15, 16, 17, 18, 19, 20, 21, or 22 amino acids from a BIM peptide sequence.

In some embodiments, a peptidomimetic macrocycle peptide derived from a human BIM peptide sequence can be a peptide comprising 1, 2, 3, 4, 5, 6, 7, 8, 9, 10, 11, 12, 13, 14, 15, 16, 17, 18, 19, 20, 21, or 22 amino acids that are different from the selected sequences from which the peptide is derived. In some embodiments, a peptidomimetic macrocycle peptide derived from a human BIM peptide sequence can be a peptide comprising a mutation at amino acid position 1, 2, 3, 4, 5, 6, 7, 8, 9, 10, 11, 12, 13, 14, 15, 16, 17, 18, 19, 20, 21, or 22. In some embodiments, mutations are mutations of non-essential amino acids. In some embodiments, mutations are mutations of essential amino acids. In some embodiments, mutations are mutations of hydrophobic amino acids. In some embodiments, mutations are mutations of naturally occurring amino acids. In some embodiments, mutations are mutations to a conservative amino acid. In some embodiments, a peptidomimetic macrocycle peptide derived from a human BIM peptide sequence can be a peptide comprising 1, 2, 3, 4, 5, 6, 7, 8, 9, 10, 11, 12, 13, 14, 15, 16, 17, 18, 19, 20, 21, or 22 amino acid analogues. In some embodiments, a peptidomimetic macrocycle peptide derived from a human BIM peptide sequence can be a peptide comprising 1 or 2 capping groups.

In some embodiments, the peptidomimetic macrocycle comprises a C-terminal truncation of 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acids from an amino acid sequence in Table 1. In some embodiments, the peptidomimetic macrocycle comprises a N-terminal truncation of 1, 2, 3, 4, 5, 6, 7, 8, 9, 10, 11, 12, 13, 14, 15, 16, 17, 18, 19, 20, 21, or 22 amino acids from the sequence of BIM.

A non-limiting list of suitable BIM macrocycles for use in the present disclosure are given in Table 1. In Table 1, at the C-terminus, some peptides possess a carboxamide terminus (shown as —NH$_2$); some peptides possess a hydroxyl terminus (shown as —OH); some peptides possess a 5-carboxyfluorescein terminus (shown as -5-FAM); some peptides possess a isobutylamide terminus (shown as —NHiBu); some peptides possess a cyclohexylamide terminus (shown as —NHChx); some peptides possess a cyclohexylmethylamide terminus (shown as —NHMeChx); some peptides possess a phenethylamide terminus (shown as —NHPe); some peptides possess a n-butylamide terminus (shown as —NHBu); some peptides possess a sec-butylamide terminus (shown as —NHsBu); and some peptides possess an uncapped terminus (shown as no terminal modification).

In Table 1, at the N-terminus, some peptides possess an acetyl terminus (shown as Ac—); some peptides possess a fluorescein isothiocyanate terminus (shown as FITC—); some peptides possess a single-unit polyethylene glycol terminus (shown as dPEG1-); some peptides possess a five-unit polyethylene glycol terminus (shown as dPEG5-); some peptides possess an eleven-unit polyethylene glycol terminus (shown as dPEG11-); some peptides possess a propyl terminus (shown as Pr—); some peptides possess a biotin terminus (shown as Biotin-); some peptides possess a KLH terminus (shown as KLH—); some peptides possess an ovalbumin terminus (shown as OVA-); some peptides possess an uncapped terminus (shown as H—); some peptides possess a isobutyl terminus (shown as iBu-); some peptides possess a decanoyl terminus (shown as Decac-); some peptides possess a benzyl terminus (shown as Bz-); some peptides possess a cyclohexyl terminus (shown as Chx-); some peptides possess a benzyl terminus (shown as Bz-); some peptides possess a Vrl terminus (shown as Vrl-); some peptides possess a HBS terminus (shown as HBS—); some peptides possess a MeIm terminus (shown as MeImC—); some peptides possess a tert-butyl terminus (shown as t-Bu-U—); some peptides possess a nonanoyl terminus (shown as non-U—); some peptides possess a ethyl terminus (shown as Et-U—); some peptides possess a cyclohexyl terminus (shown as Chx-U—); some peptides possess a isopropyl terminus (shown as iPr-U—); some peptides possess a phenyl terminus (shown as Ph-U—); some peptides possess a uric terminus (shown as NH2CO—); some peptides possess a palmitoyl terminus (shown as Pam-); some peptides possess a heptenoic terminus (shown as Hep-); and some peptides possess a 5-carboxytetramethyirhodamine terminus (shown as 5-TAMRA-).

TABLE 1

| SEQ ID NO | Peptide sequence |
|---|---|
| 1 | Ac-IWIAQELRRIGDEFNAYYARR-NH2 |
| 2 | Ac-IWIAQELR$IGD$FNAYYARR-NH2 |
| 3 | Ac-IWIAQELR$IED$FNAYYARR-NH2 |
| 4 | FITC-IWIAQELRRIGDEFNAYYARR-NH2 |
| 5 | FITC-IWIAQELR$IGD$FNAYYARR-NH2 |
| 6 | FITC-IWIAQELR$IED$FNAYYARR-NH2 |
| 7 | Ac-IWIAQQLR$IGD$FNAYYARR-NH2 |
| 8 | Ac-RWIAQQLR$IGD$FNAYYARR-NH2 |
| 9 | Ac-IRIAQQLR$IGD$FNAYYARR-NH2 |
| 10 | Ac-RRIAQQLR$IGD$FNAYYARR-NH2 |
| 11 | Ac-EIWIAQQLR$IGD$FNAYYARR-NH2 |
| 12 | Ac-ERRIAQQLR$IGD$FNAYYARR-NH2 |
| 13 | Ac-IRIAQELR$IGD$FNAYYARR-NH2 |

TABLE 1-continued

| SEQ ID NO | Peptide sequence |
|---|---|
| 14 | Ac-RWIAQELR$IGD$FNAYYARR-NH2 |
| 15 | Ac-RRIAQELR$IGD$FNAYYARR-NH2 |
| 16 | Ac-EIWIAQELR$IGD$FNAYYARR-NH2 |
| 17 | Ac-ERWIAQELR$IGD$FNAYYARR-NH2 |
| 18 | Ac-EIRIAQELR$IGD$FNAYYARR-NH2 |
| 19 | Ac-ERRIAQELR$IGD$FNAYYARR-NH2 |
| 20 | PEG1-IWIAQELR$IGD$FNAYYARR-NH2 |
| 21 | PEG5-IWIAQELR$IGD$FNAYYARR-NH2 |
| 22 | PEG11-IWIAQELR$IGD$FNAYYARR-NH2 |
| 23 | Ac-IWIAQELR$IGD$FNASYARR-NH2 |
| 24 | Ac-RRIAQELR$IGD$FNASYARR-NH2 |
| 25 | Ac-ERRIAQELR$IGD$FNASYARR-NH2 |
| 26 | Ac-RRIAQELR$IGD$FNAYYAR-NH2 |
| 27 | Ac-RRIAQELR$IGD$FNAYYA-NH2 |
| 28 | Ac-RRIAQELR$IGD$FNAYYAib-NH2 |
| 29 | Ac-RRIAQELR$IGD$FNASYAib-NH2 |
| 30 | Ac-IWIAQELR$IAibD$FNAYYAR-NH2 |
| 31 | Ac-IWIAQELR%IAibD%FNAYYAR-NH2 |
| 32 | Ac-IRIAQELRRIGDEFNETYTRR-NH2 |
| 33 | Ac-IRIAQELR$IGD$FNETYTRR-NH2 |
| 34 | Ac-IRIAQELR$IED$FNETYTRR-NH2 |
| 35 | Ac-IWIAQELR$/IGD$/FNAYYARR-NH2 |
| 36 | Pr-IWIAQELR$IGD$FNAYYARR-NH2 |
| 37 | Ac-IWIAQELR$IAibD$FNAYYARR-NH2 |
| 38 | Ac-IWIAQELR%IAibD%FNAYYARR-NH2 |
| 39 | Ac-IWIAQELR$IGD$ANAYYARR-NH2 |
| 40 | Ac-IWIAQELR$IGD$FAAYYARR-NH2 |
| 41 | Ac-IWIAQELR$IGD$AAAYYARR-NH2 |
| 42 | Ac-IWIAQELR%IGD%FNAYYARR-NH2 |
| 43 | Ac-AWIAQELR$IGD$FNAYYARR-NH2 |
| 44 | Ac-IWAAQELR$IGD$FNAYYARR-NH2 |
| 45 | Ac-AWAAQELR$IGD$FNAYYARR-NH2 |
| 46 | Ac-IWIAibQELR$IGD$FNAYYARR-NH2 |
| 47 | Ac-IWIAQELR$IGD$FNAAYARR-NH2 |
| 48 | Ac-IWIAQELR$IGD$FNAYAARR-NH2 |
| 49 | Ac-IWIAQELR$IGD$FNAAAARR-NH2 |
| 50 | Ac-IWIAQELR$IGD$FNAYYAibRR-NH2 |
| 51 | Ac-IAIAQELR%IAibD%FNAYYARR-NH2 |
| 52 | Ac-IAIAQELR$IAibD$FNAYYARR-NH2 |
| 53 | Ac-DIIRNIAibRHLA$VGD$NleDRSI-NH2 |
| 54 | Ac-DIIRNIARHLA$VGD$NleDKSI-NH2 |
| 55 | Ac-DIIKNIARHLA$VGD$NleDRSI-NH2 |
| 56 | Ac-DIIRNIARHLACVGDCNleDRSI-NH2 |
| 57 | Ac-DIIRNIARHLACVAibDCNleDRSI-NH2 |
| 58 | Ac-IWIAQELR$IGD$FNA-NH2 |
| 59 | Ac-IWIAQELR$IGD$FNRSI-NH2 |
| 60 | Ac-IWIAQELR$IGD$FNRSIARR-NH2 |
| 61 | Ac-IWIAQELR$IGD$NleDRSI-NH2 |
| 62 | Ac-IWIAQELR$VGD$NleDRSI-NH2 |
| 63 | Ac-IWIAQEAR$IGA$FNAYYARR-NH2 |
| 64 | Ac-WIAQELR$IGD$FNAYYARR-NH2 |
| 65 | Ac-IAQELR$IGD$FNAYYARR-NH2 |
| 66 | Ac-AQELR$IGD$FNAYYARR-NH2 |
| 67 | Ac-QELR$IGD$FNAYYARR-NH2 |
| 68 | Ac-ELR$IGD$FNAYYARR-NH2 |
| 69 | Ac-IWIAQELR$IGD$FNAYYAR-NH2 |
| 70 | Ac-IWIAQELR$IGD$FNAYYA-NH2 |
| 71 | Ac-IWIAQELR$IGD$FNAYY-NH2 |
| 72 | Ac-IWIAQELR$IGD$FNAY-NH2 |
| 73 | Ac-IAIAQELR$IGD$FNAYYARR-NH2 |
| 74 | Ac-IWIAAELR$IGD$FNAYYARR-NH2 |
| 75 | Ac-IWIAQALR$IGD$FNAYYARR-NH2 |
| 76 | Ac-IWIAQEAR$IGD$FNAYYARR-NH2 |
| 77 | Ac-IWIAQELA$IGD$FNAYYARR-NH2 |
| 78 | Ac-IWIAQELR$AGD$FNAYYARR-NH2 |
| 79 | Ac-IWIAQELR$IAD$FNAYYARR-NH2 |
| 80 | Ac-IWIAQELR$IGA$FNAYYARR-NH2 |
| 81 | Ac-IWIAQELR$IGD$FNAYYAAR-NH2 |
| 82 | Ac-IWIAQELR$IGD$FNAYYARA-NH2 |
| 83 | Pr-RNIARHLA$VGD$FNAYYARR-NH2 |
| 84 | Pr-RNIARHLAib$VGD$FNAYYARR-NH2 |
| 85 | Pr-RNIAibRHLAib$VGD$FNAYYARR-NH2 |
| 86 | Pr-RNChgARHLA$VAibD$FNAYYARR-NH2 |
| 87 | Pr-RNChaARHLA$VAibD$FNAYYARR-NH2 |
| 88 | FITC-BaIWIAQELRRIGDEFNAYYARR-NH2 |
| 89 | Biotin-AhxIWIAQELRRIGDEFNAYYARR-NH2 |

TABLE 1-continued

| SEQ ID NO | Peptide sequence |
|---|---|
| 90 | KLH-CBaIWIAQELRRIGDEFNAYYARR-NH2 |
| 91 | OVA-CBaIWIAQELRRIGDEFNAYYARR-NH2 |
| 92 | FITC-BaIWIAQELR$IGD$FNAYYARR-NH2 |
| 93 | Biotin-AhxIWIAQELR$IGD$FNAYYARR-NH2 |
| 94 | KLH-CBaIWIAQELR$IGD$FNAYYARR-NH2 |
| 95 | OVA-CBaIWIAQELR$IGD$FNAYYARR-NH2 |
| 96 | FITC-BaIWIAQELR$IED$FNAYYARR-NH2 |
| 97 | Biotin-AhxIWIAQELR$IED$FNAYYARR-NH2 |
| 98 | FITC-BaIWIAQELR$/IGD$/FNAYYARR-NH2 |
| 99 | Ac-BaIWIAQELR$IGD$FNAYYAR-NH2 |
| 100 | Ac-IWIAQELR%IGD%FNAYYARR-NH2 |
| 101 | H-CBaIWIAQELR$IGD$FNAYYARR-NH2 |
| 102 | Ac-IWIAQALR$IGD$FAAYYARR-NH2 |
| 103 | Ac-IWIAQALR$IAibD$FNAYYARR-NH2 |
| 104 | Ac-IWIAQ$LRR$GDEFNAYYARR-NH2 |
| 105 | Ac-IWIAQ$LRR$GDAFNAYYARR-NH2 |
| 106 | Ac-IWIAQ$LRA$GDAFNAYYARR-NH2 |
| 107 | Ac-IWI$QEL$RIGDEFNAYYARR-NH2 |
| 108 | Ac-IWI$QAL$RIGDEFNAYYARR-NH2 |
| 109 | Ac-IWI$QEL$RIGDAFNAYYARR-NH2 |
| 110 | Ac-IWI$QAL$RIGDAFNAYYARR-NH2 |
| 111 | Ac-IWIAQALR$IGD$ANAYYARR-NH2 |
| 112 | Ac-RWIAQALR$IGD$FNAYYARR-NH2 |
| 113 | Ac-RNIAQELR$IGD$FNAYYARR-NH2 |
| 114 | Ac-RNIAQALR$IGD$FNAYYARR-NH2 |
| 115 | Ac-RRIAQALR$IGD$FNAYYARR-NH2 |
| 116 | Ac-RNIAQALR$IGD$ANAYYARR-NH2 |
| 117 | Ac-RRIAQALR$IGD$ANAYYARR-NH2 |
| 118 | H-IWIAQELR$IGD$FNAYYARR-NH2 |
| 119 | Ac-IWIAQEChaR$IGD$FNAYYARR-NH2 |
| 120 | Ac-IWChgAQELR$IGD$FNAYYARR-NH2 |
| 121 | Ac-IRIAQALR$IGD$FNAYYARR-NH2 |
| 122 | Ac-IWIAQAibLR$IGD$FNAYYARR-NH2 |
| 123 | Ac-IWIAibQALR$IGD$FNAYYARR-NH2 |
| 124 | Ac-IWIAQALR$IGD$FNAibYYARR-NH2 |
| 125 | Ac-IWIAQALR$IGD$FNAYYAibRR-NH2 |
| 126 | Ac-IWIAQALR$IGD$FNASIARR-NH2 |
| 127 | Ac-IWIAQALR$IGD$FNAFYARR-NH2 |
| 128 | Ac-IWIAQALR$IGD$FNAFFARR-NH2 |
| 129 | Ac-IWIAQALR$IGD$FNARRA-NH2 |
| 130 | Ac-IWIAQALR$IGD$FNAYKA-NH2 |
| 131 | Ac-IWIAQALR$IGD$FNAYK-NH2 |
| 132 | Ac-IWIAQALR$IGD$FNASKARR-NH2 |
| 133 | Ac-RRIAQQLR$IGD$ANAYYARR-NH2 |
| 134 | Ac-WIAQQLR$IGD$FNAYYARR-NH2 |
| 135 | Pr-WIAQQLR$IGD$FNAYYARR-NH2 |
| 136 | Ac-RWIAQQLR$IGN$FNAYYARR-NH2 |
| 137 | H-NMeRWIAQQLR$IGD$FNAYYARR-NH2 |
| 138 | Ac-NMeRWIAQQLR$IGD$FNAYYARR-NH2 |
| 139 | Ac-IWIAQHLR$IGD$FNAYYARR-NH2 |
| 140 | Ac-RWIAQHLR$IGD$FNAYYARR-NH2 |
| 141 | Ac-RWIAQELR$ChgGD$FNAYYARR-NH2 |
| 142 | Ac-RWIAQELR$ChaGD$FNAYYARR-NH2 |
| 143 | Ac-IWIAQQLR$IGD$FNAFFARR-NH2 |
| 144 | Ac-RWIAQQLR$IGD$FNAFYARR-NH2 |
| 145 | Ac-RWIAQQLR$IGD$FNAFARR-NH2 |
| 146 | Ac-RWIAQQLR$IGD$FNATIARR-NH2 |
| 147 | Ac-RWIAQQLR$IGD$FNAYYAR-NH2 |
| 148 | Ac-RWIAQQLR$IGD$FNAYYA-NH2 |
| 149 | Ac-RWIAQQLR$IGD$FNAYY-NH2 |
| 150 | Ac-IWIAQ$LRR$GDQFNAYYARR-NH2 |
| 151 | Ac-IWIAQ$LRQ$GDQFNAYYARR-NH2 |
| 152 | Ac-RWIAQ$LRA$GDQFNAYYARR-NH2 |
| 153 | H-CBaIWIAQELRRIGDEFNAYYARR-NH2 |
| 154 | H-CBaIWIAQELRRIGDEFNAYYARR-NH2 |
| 155 | H-CBaIWIAQELR$IGD$FNAYYARR-NH2 |
| 156 | H-CBaIWIAQELR$IGD$FNAYYARR-NH2 |
| 157 | Ac-RRIAQQLR$IGD$FNAYYAR-NH2 |
| 158 | Ac-RRIAQALR$IGD$FNAYYAR-NH2 |
| 159 | Ac-RRIAQQLR$IGD$FNAYYA-NH2 |
| 160 | Ac-IWIAQQLR$IGD$FNARRA-NH2 |
| 161 | Ac-RWIAQQLR$IGD$FNARRA-NH2 |
| 162 | Ac-RRIAQQLR$IGD$FNARRA-NH2 |
| 163 | Ac-RRIAQQLR$IGD$FNARRA-NH2 |
| 164 | Ac-RWIAQQLR$IGD$FNARYA-NH2 |
| 165 | Ac-RWIAQQLR$IGD$FNAYRA-NH2 |

TABLE 1-continued

| SEQ ID NO | Peptide sequence |
|---|---|
| 166 | Ac-RWIAQQLR$IGD$FNARYA-NH2 |
| 167 | Ac-RWIAQQLR$IGD$FNAYRA-NH2 |
| 168 | Ac-RRIAQQLR$IGD$FNASIA-NH2 |
| 169 | Ac-RRIAQALR$IGD$FNASIA-NH2 |
| 170 | Ac-RRIAQALR$IGD$FNASI-NH2 |
| 171 | Ac-RWIAQQLR$IGD$FNARR-NH2 |
| 172 | Ac-RWIAQQLR$IGD$FNAR-NH2 |
| 173 | Ac-RRIAQQLR$IGD$FNAR-NH2 |
| 174 | Ac-RRIAQQLR$IGD$FNAib-NH2 |
| 175 | Ac-RRIAQQLR$IGD$FNA-NH2 |
| 176 | Ac-RRIAQQLR$IGD$FNARRA-NH2 |
| 177 | Ac-RRIAQQLR$IGD$FNAYYA-NH2 |
| 178 | Ac-RRIAQQLR$IGD$FNAYYAib-NH2 |
| 179 | Ac-RWIAQQLR$IGD$FNAibRRA-NH2 |
| 180 | Ac-RWIAibQQLR$IGD$FNARRA-NH2 |
| 181 | Ac-RWAibAQQLR$IGD$FNARRA-NH2 |
| 182 | Ac-RAibIAQQLR$IGD$FNARRA-NH2 |
| 183 | Ac-RFIAQQLR$IGD$FNAYYARR-NH2 |
| 184 | Ac-RFIAQQLR$IGD$FNARRA-NH2 |
| 185 | Ac-RAibIAQQLR$IGD$FNAYYARR-NH2 |
| 186 | Ac-RWIAQQhFR$IGD$FNAYYARR-NH2 |
| 187 | Ac-RWIAQQ3cfR$IGD$FNAYYARR-NH2 |
| 188 | Ac-RWIAQQ1NalR$IGD$FNAYYARR-NH2 |
| 189 | Ac-RWIAQQ2NalR$IGD$FNAYYARR-NH2 |
| 190 | Ac-IWIAQEAR$IGD$ANAYYARR-NH2 |
| 191 | Ac-RRI$QAL$RIGDAibFNARRA-NH2 |
| 192 | Ac-RRIAQ$LRR$GDAibFNARRA-NH2 |
| 193 | iBu-RWIAQQLR$IGD$FNAYYARR-NH2 |
| 194 | Dec-RWIAQQLR$IGD$FNAYYARR-NH2 |
| 195 | Bz-RWIAQQLR$IGD$FNAYYARR-NH2 |
| 196 | H-RWIAQQLR$IGD$FNAYYARR-NH2 |
| 197 | Chx-RWIAQQLR$IGD$FNAYYARR-NH2 |
| 198 | Vrl-RWIAQQLR$IGD$FNAYYARR-NH2 |
| 199 | PhAc-RWIAQQLR$IGD$FNAYYARR-NH2 |
| 200 | MeImC-RWIAQQLR$IGD$FNAYYARR-NH2 |
| 201 | Pr-RWIAQQLR$IGD$FNAYYARR-NH2 |
| 202 | Ac-RWIAQALR$IGD$FNASIARR-NH2 |
| 203 | Ac-RWIAQQLR$IGD$FNASIARR-NH2 |
| 204 | Ac-RWIAQALR$IGD$FNAFYARR-NH2 |
| 205 | Ac-RRIAQALR$IGD$FNAFYA-NH2 |
| 206 | Ac-RRIAQQLR$IGD$FNAFYA-NH2 |
| 207 | Ac-RWIAQALR$IGD$FNAYYARR-NHPr |
| 208 | Ac-RWIAQALR$IGD$FNAYYARR-NHiBu |
| 209 | Ac-RWIAQALR$IGD$FNAYYARR-NHChx |
| 210 | Ac-RWIAQALR$IGD$FNAYYARR-NHBn |
| 211 | Ac-RWIAQALR$IGD$FNAYYARR-NHMeChx |
| 212 | Ac-RWIAQALR$IGD$FNAYYARR-NHEtPh |
| 213 | Ac-RWIAQALR$IGD$FNAYYARR-NHsBu |
| 214 | Ac-RWIAQALR$IGD$FNARR-NHPr |
| 215 | Ac-RWIAQALR$IGD$FNARR-NHiBu |
| 216 | Ac-RWIAQALR$IGD$FNARR-NHChx |
| 217 | Ac-RWIAQALR$IGD$FNARR-NHBn |
| 218 | Ac-RWIAQALR$IGD$FNARR-NHMeChx |
| 219 | Ac-RWIAQALR$IGD$FNARR-NHEtPh |
| 220 | Ac-RWIAQALR$IGD$FNARR-NHsBu |
| 221 | Ac-RWIAQALR$IGA$FNAYYARR-NH2 |
| 222 | Ac-RWIAQALR$IGN$FNAYYARR-NH2 |
| 223 | Ac-IWIAQALR$IGA$FNARRA-NH2 |
| 224 | Ac-IWIAQALR$IGN$FNARRA-NH2 |
| 225 | Ac-RWIAQAFR$IGD$FNAYYARR-NH2 |
| 226 | H-CAhxIWIAQELRRIGDEFNAYYARR-NH2 |
| 227 | H-CAhxIWIAQELR$IGD$FNAYYARR-NH2 |
| 228 | Pr-IPIAQALR$IGD$FNARRA-NH2 |
| 229 | Pr-PWIAQALR$IGD$FNARRA-NH2 |
| 230 | KLH-CAhxIWIAQELRRIGDEFNAYYARR-NH2 |
| 231 | OVA-CAhxIWIAQELRRIGDEFNAYYARR-NH2 |
| 232 | KLH-CAhxIWIAQELR$IGD$FNAYYARR-NH2 |
| 233 | OVA-CAhxIWIAQELR$IGD$FNAYYARR-NH2 |
| 234 | Ac-IWIAEELA$IGD$FDAYYA-NH2 |
| 235 | FITC-BaIWIAEELA$IGD$FDAYYA-NH2 |
| 236 | Ac-IWIAEELA$IGD$FDAYYAAA-NH2 |
| 237 | FITC-BaIWIAEELA$IGD$FDAYYAAA-NH2 |
| 238 | Ac-RWIAQALR$IGD$FNAYKARR-NH2 |
| 239 | Ac-RWIAQQLR$IGD$FNAYKARR-NH2 |
| 240 | Ac-RWIAQALR$IGD$FNAYK-NH2 |
| 241 | Ac-RWIAQALR$IGD$FNAFK-NH2 |

TABLE 1-continued

| SEQ ID NO | Peptide sequence |
|---|---|
| 242 | Ac-RWIAQALR$IGD$hFNAYYARR-NH2 |
| 243 | Ac-RWIAQALR$IGD$1NalNAYYARR-NH2 |
| 244 | Ac-RWIAQALR$IGD$2NalNAYYARR-NH2 |
| 245 | Ac-R2NalIAQALR$IGD$FNAYYARR-NH2 |
| 246 | Ac-RhFIAQALR$IGD$FNAYYARR-NH2 |
| 247 | Ac-RWIAQALR$IGNle$FNAYYARR-NH2 |
| 248 | Ac-RWNleAQALR$IGD$FNAYYARR-NH2 |
| 249 | Ac-RWIAQNleLR$IGD$FNAYYARR-NH2 |
| 250 | Ac-RWIAQQLR$IGD$FNAYK-NH2 |
| 251 | H-CAhxIWIAQELR$IED$FNAYYARR-NH2 |
| 252 | Ac-IWIAQALR$IGD$FNAYOrnARR-NH2 |
| 253 | Ac-IWIAQALR$IGD$FNAYOrn-NH2 |
| 254 | Ac-IWIAQALR$IGD$FNAYR-NH2 |
| 255 | Ac-IWIAQALR$IGD$FNAYRA-NH2 |
| 256 | Ac-IWIAQALR$IFD$FNARRA-NH2 |
| 257 | Ac-RWIAQALR$IGD$FNARRA-NH2 |
| 258 | Ac-IWIAQELR$ChgGD$FNAYYARR-NH2 |
| 259 | Ac-IWIAQQLR$IGD$FNAYY-NH2 |
| 260 | Ac-IWIAQ$LRA$GDQFNAYYARR-NH2 |
| 261 | Ac-IWIAQALR$IGD$FAibAYK-NH2 |
| 262 | Ac-IWIAQALR$IGD$FAibAYYARR-NH2 |
| 263 | Ac-IWIAQALR$IGN$FNAFYARR-NH2 |
| 264 | Ac-RWIAQALR$IGN$FNAFYARR-NH2 |
| 265 | Ac-IWIAQAibLR$IGN$FNAFYARR-NH2 |
| 266 | Ac-IWIAQALR$IGN$FNAibFYARR-NH2 |
| 267 | Ac-IWIAQAibLR$IGN$FNAibFYARR-NH2 |
| 268 | Pr-RNChgARHLA$VAibD$FNAFYARR-NH2 |
| 269 | Ac-IWIAQAAR$IGD$FNAYYARR-NH2 |
| 270 | Ac-IWIAQAAR$IGD$ANAYYARR-NH2 |
| 271 | Ac-IWIAQAAR$IGA$ANAYYARR-NH2 |
| 272 | Ac-IWIAQAAR$IEA$ANAYYARR-NH2 |
| 273 | Ac-IWIAQALR$DIG$FNAYYARR-NH2 |
| 274 | Ac-IWIAQAAR$DIG$ANAYYARR-NH2 |
| 275 | Ac-IWIAQALR$IED$FNAYYARR-NH2 |
| 276 | Ac-IWIAQALD$IGR$FNAYYARR-NH2 |
| 277 | Ac-IWIAQAAD$IGR$ANAYYARR-NH2 |
| 278 | Ac-IWIAQAAD$IER$ANAYYARR-NH2 |
| 279 | Ac-IWIAQAibLR$IGD$FNAibYYARR-NH2 |
| 280 | Ac-IWIAQQLR$IGD$FNAYRA-NH2 |
| 281 | Ac-IWI$QAL$RIGDAibFNAYYARR-NH2 |
| 282 | t-Bu-U-IWIAQELR$IGD$FNAYYARR-NH2 |
| 283 | non-U-IWIAQELR$IGD$FNAYYARR-NH2 |
| 284 | Et-U-IWIAQELR$IGD$FNAYYARR-NH2 |
| 285 | Chx-U-IWIAQELR$IGD$FNAYYARR-NH2 |
| 286 | iPr-U-IWIAQELR$IGD$FNAYYARR-NH2 |
| 287 | Ph-U-IWIAQELR$IGD$FNAYYARR-NH2 |
| 288 | NH2CO-IWIAQELR$IGD$FNAYYARR-NH2 |
| 289 | Ac-IWIAQAAR$IGR$ANAYYARR-NH2 |
| 290 | Ac-IWIAQAAD$IGD$ANAYYARR-NH2 |
| 291 | Ac-IWIAQALD$IGD$FNAYYARR-NH2 |
| 292 | Ac-IWIAQALR$IGR$FNAYYARR-NH2 |
| 293 | Ac-IWIAQAAR$IGD$ANAYYARR-NH2 |
| 294 | Ac-IWIAQAAD$IGR$ANAYYARR-NH2 |
| 295 | Ac-IWIAQALD$IGR$FNAYYARR-NH2 |
| 296 | Ac-IWIAQALRRIGDEFNAYYARR-NH2 |
| 297 | Ac-IWIAQALR$IGN$FNAYYARR-NH2 |
| 298 | Ac-IWIAQALR$IGNle$FNAYYARR-NH2 |
| 299 | Ac-IWIAQALR$IGA$FNAFYARR-NH2 |
| 300 | Ac-IWIAQALR$IGN$FNAFYARR-NH2 |
| 301 | Ac-IWIAQALR$IGNle$FNAFYARR-NH2 |
| 302 | Ac-RWIAQAFR$IGD$FNAFYARR-NH2 |
| 303 | Ac-IWIAQAFR$IGD$FNAFYARR-NH2 |
| 304 | Ac-IWIAQAFR$IGN$FNAYYARR-NH2 |
| 305 | Ac-IWIAQAFR$IGN$FNAFYARR-NH2 |
| 306 | Ac-IWIAQALR$IG$EFNAYYARR-NH2 |
| 307 | Ac-IWIAQALRR$GD$FNAYYARR-NH2 |
| 308 | Ac-IWIAQALRAibIGAmDEFNAYYARR-NH2 |
| 309 | Ac-IWIAQELR#IGD#FNAYYARR-NH2 |
| 310 | Ac-IWIAQELR$IGD#FNAYYARR-NH2 |
| 311 | Ac-IWIAQELR#IGD$FNAYYARR-NH2 |
| 312 | Ac-IWIAQALR$IGD$FNAYYARR-NHiBu |
| 313 | Chx-IWIAQALR$IGD$FNAYYARR-NHiBu |
| 314 | Chx-U-IWIAQALR$IGD$FNAYYARR-NHiBu |
| 315 | FITC-AhxIWIAQALR$IGD$FNAibYYARR-NH2 |
| 316 | FITC-AhxIWIAQALR$IGD$FNAFYARR-NH2 |
| 317 | FITC-AhxRWIAQALR$IGD$FNAFYARR-NH2 |

TABLE 1-continued

| SEQ ID NO | Peptide sequence |
|---|---|
| 318 | FITC-AhxRW1AQALR$IGN$FNAYYARR-NH2 |
| 319 | FITC-AhxRWIAQALR$IGNle$FNAYYARR-NH2 |
| 320 | FITC-AhxIWIAQALR$IGN$FNAYYARR-NH2 |
| 321 | FITC-AhxIWIAQALR$IGNle$FNAYYARR-NH2 |
| 322 | Ac-IWIAQELRbKIGDbEFNAYYARR-NH2 |
| 323 | Ac-IWIAQELRbEIGDbKFNAYYARR-NH2 |
| 324 | Ac-IWIAQELRbKIAibDbEFNAYYARR-NH2 |
| 325 | Ac-IWIAQELRbEIAibDbKFNAYYARR-NH2 |
| 326 | Ac-IWIAQELR#sIGD#sFNAYYARR-NH2 |
| 327 | Ac-IWIAQELR#sIAibD#sFNAYYARR-NH2 |
| 328 | Ac-IWIAQELR$s1GD$sFNAYYARR-NH2 |
| 329 | Ac-IAmWIAQELR$IGD$FNAYYARR-NH2 |
| 330 | Ac-IWIAQELR$r5IGD$r5FNAYYARR-NH2 |
| 331 | Ac-IWIA$r5ELR$r5IGDEFNAYYARR-NH2 |
| 332 | Ac-IWIA$ELR$IGDEFNAYYARR-NH2 |
| 333 | Ac-IWIAQ$r8LRRIGD$FNAYYARR-NH2 |
| 334 | Ac-I$r8IAQELR$IGDEFNAYYARR-NH2 |
| 335 | HepIAQ$LRRIGDEFNAYYARR-NH2 |
| 336 | HepIAQ$LR$IGD$FNAYYARR-NH2 |
| 337 | HepWIA$ELRRIGDEFNAYYARR-NH2 |
| 338 | HepWIA$ELR$IGD$FNAYYARR-NH2 |
| 339 | Ac-I$IAQ$LRRIGDEFNAYYARR-NH2 |
| 340 | Ac-I$IAQ$LR$IGD$FNAYYARR-NH2 |
| 341 | Ac-IWIAQALE$IGD$FNAYYARR-NH2 |
| 342 | Ac-IWIAQALR$IGR$ANAYYARR-NH2 |
| 343 | Ac-IWIAQAAESIGR$ANAYYARR-NH2 |
| 344 | Ac-IWIAQAAE$IGE$ANAYYARR-NH2 |
| 345 | Ac-RWIAQALR$IGR$FNAFYARR-NH2 |
| 346 | Ac-RWIAQALE$IGD$FNAFYARR-NH2 |
| 347 | Ac-RWIAQAAR$IGR$ANAYYARR-NH2 |
| 348 | Ac-RWIAQAAE$IGD$ANAFYARR-NH2 |
| 349 | Ac-RWIAQAAD$IGD$ANAYYARR-NH2 |
| 350 | Ac-RWIAQAAESIGR$ANAFYARR-NH2 |
| 351 | Ac-RWIAQAAR$IGD$ANAYYARR-NH2 |
| 352 | Ac-RWIAQALR$DIG$FNAFYARR-NH2 |
| 353 | Ac-RWIAQALR$IGN$ANAYYARR-NH2 |
| 354 | Ac-RWIAQAAR$IGN$ANAYYARR-NH2 |
| 355 | Ac-RWIAQAAESIGN$ANAYYARR-NH2 |
| 356 | Ac-RWIAQAAESIGN$ANAYYARR-NH2 |
| 357 | Ac-RWIAQAAE$NIG$ANAYYARR-NH2 |
| 358 | Ac-RWIAQAAR$NIG$ANAYYARR-NH2 |
| 359 | Ac-IWIAQALR$IGN$ANAYYARR-NH2 |
| 360 | Ac-IWIAQAAR$IGN$ANAYYARR-NH2 |
| 361 | Ac-IWIAQAAE$IGN$ANAYYARR-NH2 |
| 362 | Ac-IWIAQAAE$IGN$ANAYYARR-NH2 |
| 363 | Ac-IWIAQAAE$NIG$ANAYYARR-NH2 |
| 364 | Ac-IWIAQAAR$NIG$ANAYYARR-NH2 |
| 365 | Ac-RWIAQALRRIGNEFNAYYARR-NH2 |
| 366 | Ac-IWIAQALRRIGNEFNAYYARR-NH2 |
| 367 | Ac-RWIAQALR$IEN$FNAYYARR-NH2 |
| 368 | Ac-RWIAQALR$IED$FNAFYARR-NH2 |
| 369 | Ac-IWIAQALR$IED$FNAFYARR-NH2 |
| 370 | Ac-IWIAQELR$IGR$FNAYYARR-NH2 |
| 371 | Ac-IWIAQELRbKIGDbDFNAYYARR-NH2 |
| 372 | Ac-IWIAQELRbDIGDbKFNAYYARR-NH2 |
| 373 | FITC-AhxRWIAQALRRIGDEFNAFYARR-NH2 |
| 374 | FITC-AhxRWIAQALRRIGNEFNAYYARR-NH2 |
| 375 | FITC-AhxIWIAQALRRIGNEFNAYYARR-NH2 |
| 376 | FITC-AhxIWIAQELRRIGDEFNAYYARR-NH2 |
| 377 | Ac-RWIAQALR$/IGN$/FNAYYARR-NH2 |
| 378 | Ac-IWIAQELR#cIGR#cFNAYYARR-NH2 |
| 379 | Ac-IWIAQELRCIGRCFNAYYARR-NH2 |
| 380 | FITC-AhxIWIAQAAR$DIG$ANAYYARR-NH2 |
| 381 | Ac-IWIAQQLR%IGD%FNAYYARR-NH2 |
| 382 | FITC-AhxRNIARHLA$VGD$NleAibRSI-NH2 |
| 383 | FITC-AhxIWIAQALR$IGD$FNAYYARR-NH2 |
| 384 | Ac-IWIAQELR#c4IGD#c4FNAYYARR-NH2 |
| 385 | Ac-IWIAQELR$c4IGD$c4FNAYYARR-NH2 |
| 386 | Ac-IWIAQELR#cIGD#cFNAYYARR-NH2 |
| 387 | Ac-IWIAQELR$cIGD$cFNAYYARR-NH2 |
| 388 | FITC-AhxIWIAQELR#IGD#FNAYYARR-NH2 |
| 389 | 5-FAM-AhxIWIAQELR#c4IGD#c4FNAYYARR-NH2 |
| 390 | 5-FAM-AhxIWIAQELR$c4IGD$c4INAYYARR-NH2 |
| 391 | FITC-AhxIWIAQELR#cIGD#cFNAYYARR-NH2 |
| 392 | FITC-AhxIWIAQELR#sIGD#sFNAYYARR-NH2 |
| 393 | FITC-AhxIWIAQELR$cIGD$cFNAYYARR-NH2 |

TABLE 1-continued

| SEQ ID NO | Peptide sequence |
|---|---|
| 394 | Ac-IWIAQELR$4n4IGD$4a5FNAYYARR-NH2 |
| 395 | Ac-IWIAQELR$4a5IGD$4n4FNAYYARR-NH2 |
| 396 | Ac-IWIAQELR$5n3IGD$5a5FNAYYARR-NH2 |
| 397 | Ac-IWIAQELR$5a5IGD$5n3FNAYYARR-NH2 |
| 398 | Ac-IWIAQELR#5n3IGD#5a5FNAYYARR-NH2 |
| 399 | Ac-IWIAQELR#5a5IGD#5n3FNAYYARR-NH2 |
| 400 | FITC-AhxIWIAQELR$4n4IGD$4a5FNAYYARR-NH2 |
| 401 | FITC-AhxIWIAQELR$4a5IGD$4n4FNAYYARR-NH2 |
| 402 | FITC-AhxIWIAQELR$5n3IGD$5a5FNAYYARR-NH2 |
| 403 | FITC-AhxIWIAQELR$5a5IGD$5n3FNAYYARR-NH2 |
| 404 | FITC-AhxIWIAQELR#5n3IGD#5a5FNAYYARR-NH2 |
| 405 | FITC-AhxIWIAQELR#5a5IGD#5n3FNAYYARR-NH2 |
| 406 | Ac-IWIAQALR$IEN$FNAYYARR-NH2 |
| 407 | Ac-RWIAQALR$/IGD$/FNAFYARR-NH2 |
| 408 | Ac-IWIAQALR$/IGN$/FNAYYARR-NH2 |
| 409 | Ac-IWIAQALR$/IGD$/FNAYYARR-NH2 |
| 410 | Ac-RWIChaQALR$IGD$FNAFYARR-NH2 |
| 411 | Ac-RWIAQALR$IChaD$FNAFYARR-NH2 |
| 412 | Ac-RWIAQALR$IGD$FNAFYARR-NH2 |
| 413 | Ac-RWIAQALR$IGD$FNChaFYARR-NH2 |
| 414 | Ac-RWIAQALR$IGD$FNAFYChaRR-NH2 |
| 415 | Ac-IWIChaQALR$IGN$FNAYYARR-NH2 |
| 416 | Ac-IWIAQALR$IChaN$FNAYYARR-NH2 |
| 417 | Ac-IWIAQALR$IGN$FNAYYARR-NH2 |
| 418 | Ac-IWIAQALR$IGN$FNChaYYARR-NH2 |
| 419 | Ac-IWIAQALR$IGN$FNAYYChaRR-NH2 |
| 420 | HepIAQ$LR$IGD$FNAFYARR-NH2 |
| 421 | Ac-YGRKKRRQRRRIWIAQELRRIGDEFNAYYARR-NH2 |
| 422 | FITC-AhxYGRKKRRQRRRIWIAQELRRIGDEFNAYYARR-NH2 |
| 423 | Ac-RWIAQALR$IGD$FNAFYAHR-NH2 |
| 424 | Ac-RWIAQALR$IGD$FNAFYARH-NH2 |
| 425 | Ac-RWIAQSLR$IGD$FNAFYARR-NH2 |
| 426 | Ac-IWIAQELR#4n4IGD#4a5FNAYYARR-NH2 |
| 427 | FITC-AhxRWIAQALR$/IGN$/FNAYYARR-NH2 |
| 428 | FITC-AhxRWIAQALR$/IGD$/FNAFYARR-NH2 |
| 429 | FITC-AhxIWIAQALR$/IGN$/FNAYYARR-NH2 |
| 430 | FITC-AhxIWIAQALR$/IGD$/FNAYYARR-NH2 |
| 431 | FITC-AhxIWIAQELR$sIGD$sFNAYYARR-NH2 |
| 432 | Biotin-AhxRWIAQALRRIGDEFNAFYARR-NH2 |
| 433 | Biotin-AhxRWIAQALRRIGNEFNAYYARR-NH2 |
| 434 | Biotin-AhxIWIAQALRRIGNEFNAYYARR-NH2 |
| 435 | Biotin-AhxIWIAQALRRIGDEFNAYYARR-NH2 |
| 436 | FITC-AhxIWIAQALRRIGDEFNAYYARR-NH2 |
| 437 | Biotin-AhxRWIAQALR$IGD$FNAFYARR-NH2 |
| 438 | Biotin-AhxRWIAQALR$IGN$FNAYYARR-NH2 |
| 439 | Biotin-AhxIWIAQALR$IGN$FNAYYARR-NH2 |
| 440 | Biotin-AhxIWIAQALR$IGD$FNAYYARR-NH2 |
| 441 | Biotin-AhxIWIAQALR$IGD$FNAFYARR-NH2 |
| 442 | 5-FAM-AhxIWIAQELR$IGD$FNAYYARR-NH2 |
| 443 | DuIAQDprLRRIGDEFNAYYARR-NH2 |
| 444 | DuIAQDprLRRIGDQFNAYYARR-NH2 |
| 445 | DuWIADprALRRIGDEFNAYYARR-NH2 |
| 446 | DuWIADprALRRIGDQFNAYYARR-NH2 |
| 447 | 5-FAM-AhxIWIAQALRRIGDEFNAYYARR-NH2 |
| 448 | 5-FAM-AhxIWIAQELR$IGD$FNAYYARR-NH2 |
| 449 | 5-FAM-AhxIWIAQAARRDIGEANAYYARR-NH2 |
| 450 | 5-FAM-AhxRWIAQALR$IGD$FNAFYARR-NH2 |
| 451 | 5-FAM-AhxIWIAQALRRIGDEFNAFYARR-NH2 |
| 452 | Ac-IWIAQEAmLR$IGD$FNAYYARR-NH2 |
| 453 | Ac-IWIAQELR$IGD$FNAibYYARR-NH2 |
| 454 | Ac-IWIAQELR$IGD$FNAAmfYARR-NH2 |
| 455 | Ac-IWIAQELR$IGD$FNAYAmfARR-NH2 |
| 456 | Ac-IWIAQELR$IGD$FNAAmyeYARR-NH2 |
| 457 | Ac-IWIAQELR$IGD$FNAYAmyeARR-NH2 |
| 458 | Ac-IWIAQELR$IGD$FNAYYAmrR-NH2 |
| 459 | Ac-IWIAQELR$IGD$FNAYFARR-NH2 |
| 460 | Ac-IWIAQELR$IGD$FNAFYARR-NH2 |
| 461 | Ac-RWIAQELR$IGD$FNAFYARR-NH2 |
| 462 | Ac-RWIAQALR$IGD$FNAAmfYARR-NH2 |
| 463 | Ac-RWIAQALR$IGD$FNAYAmrR-NH2 |
| 464 | Ac-IWIA$r5ALRStIGD$FNAYYARR-NH2 |
| 465 | Ac-IWIA$ALRStIGDEFN$s8YYARR-NH2 |
| 466 | Ac-IWIAQALR$r5IGDStFNA$YARR-NH2 |
| 467 | 5-FAM-AhxIWIAQELRbKIGDbDFNAYYARR-NH2 |
| 468 | 5-FAM-AhxIWIAQELRbDIGDbKFNAYYARR-NH2 |
| 469 | 5-FAM-AhxIWIAQELR#IGD#FNAYYARR-NH2 |

TABLE 1-continued

| SEQ ID NO | Peptide sequence |
|---|---|
| 470 | 5-FAM-AhxIWIAQELR#cmlIGD#cmlFNAYYARR-NH2 |
| 471 | 5-FAM-AhxRWIAQALR$IGD$FNAFYAHR-NH2 |
| 472 | 5-FAM-AhxRWIAQALRRIGDEFNAFYAHR-NH2 |
| 473 | 5-FAM-AhxRWIAQALR$IGD$FNAFYARH-NH2 |
| 474 | 5-FAM-AhxRWIAQALRRIGDEFNAFYARH-NH2 |
| 475 | Ac-RWIAQALR$IGD$FNAFYAAR-NH2 |
| 476 | Ac-RWIAQALR$IGD$FNAFYARA-NH2 |
| 477 | Ac-RWIAQAAR$D1G$ANAFYARR-NH2 |
| 478 | Ac-IWIAQAAR$DIG$ANAFYARR-NH2 |
| 479 | 5-FAM-AhxIWIAQELR$IED$FNAYYARR-NH2 |
| 480 | 5-FAM-AhxIWIAQELRRIEDEFNAYYARR-NH2 |
| 481 | Ac-IWIAQELRNleIGDNleFNAYYARR-NH2 |
| 482 | Ac-IWIAQELRAibIGDAibFNAYYARR-NH2 |
| 483 | 5-FAM-AhxRWIAQALR$IGD$FNAFYARR-NH2 |
| 484 | 5-FAM-AhxRWIAQALRRIGDEFNAFYARR-NH2 |
| 485 | H-CAhxIWIAQALR$IGD$FNAFYARR-NH2 |
| 486 | H-CAhxRWIAQALR$IGD$FNAFYARR-NH2 |
| 487 | 5-FAM-AhxRWIAQALR$IGD$FNAFYARR-NH2 |
| 488 | OVA-CAhxIWIAQELR$IGD$FNAYYARR-NH2 |
| 489 | OVA-CAhxRWIAQQLR$IGD$FNAYYARR-NH2 |
| 490 | H-CAhxRWIAQAAR$IGR$ANAFYARR-NH2 |
| 491 | H-CAhxRWIAQALR$IGD$FNAYYARR-NH2 |
| 492 | H-CAhxRWIAQALRRIGDEFNAYYARR-NH2 |
| 493 | OVA-CAhxRWIAQAAR$IGD$ANAYYARR-NH2 |
| 494 | OVA-CAhxRWIAQALR$IGD$FNAYYARR-NH2 |
| 495 | OVA-CAhxIWIAQALRRIGDEFNAYYARR-NH2 |
| 496 | Ac-6xhAhxIWIAQAAR$DIG$ANAYYARR-NH2 |
| 497 | Ac-FlagAhxIWIAQAAR$DIG$ANAYYARR-NH2 |
| 498 | 5-FAM-6xhAhxIWIAQAAR$DIG$ANAYYARR-NH2 |
| 499 | 5-FAM-FlagAhxIWIAQAAR$DIG$ANAYYARR-NH2 |
| 500 | Ac-6xhAhxRWIAQALR$IGD$FNAFYARR-NH2 |
| 501 | Ac-FlagAhxRWIAQALR$IGD$FNAFYARR-NH2 |
| 502 | 5-FAM-6xhAhxRWIAQALR$IGD$FNAFYARR-NH2 |
| 503 | 5-FAM-FlagAhxRWIAQALR$IGD$FNAFYARR-NH2 |
| 504 | 5-FAM-IWIAQELR$IGD$FNAYYARR-NH2 |
| 505 | 5-FAM-BaIWIAQELR$IGD$FNAYYARR-NH2 |
| 506 | Ac-IWIAQELR%OcoIGD%OcoFNAYYARR-NH2 |
| 507 | Ac-AhxIWIAQELR$IGD$FNAYYARR-NH2 |
| 508 | Ac-BaIWIAQELR$IGD$FNAYYARR-NH2 |
| 509 | H-CAhxIWIAQALR$IGD$FNAYYARR-NH2 |
| 510 | 5-FAM-AhxIWIAQELR$/IGD$/FNAYYARR-NH2 |
| 511 | AC-RWIAQALRRIGDEFNAFYAHH-NH2 |
| 512 | 5-FAM-AhxRWIAQALR$IGD$FNAFYAHH-NH2 |
| 513 | 5-FAM-AhxIWIAQELRRIGDEFNAYYARR-NH2 |
| 514 | Ac-TatAhxIWIAQELRRIGDEFNAYYARR-NH2 |
| 515 | 5-FAM-TatAhxIWIAQELRRIGDEFNAYYARR-NH2 |
| 516 | Ac-TatAhxIWIAQELR$IGD$FNAYYARR-NH2 |
| 517 | 5-FAM-TatAhxIWIAQELR$IGD$FNAYYARR-NH2 |
| 518 | Ac-TatAhxRWIAQALR$IGDSFNAFYARR-NH2 |
| 519 | 5-FAM-TatAhxRWIAQALR$IGD$FNAFYARR-NH2 |
| 520 | Ac-TatAhxRWIAQALRRIGDEFNAFYARR-NH2 |
| 521 | 5-FAM-TatAhxRWIAQALRRIGDEFNAFYARR-NH2 |
| 522 | 5-FAM-AhxRWIAQALR$/IGD$/FNAFYARR-NH2 |
| 523 | 5-FAM-AhxIWIAQELRS/IGD$/FKAFYARR-NH2 |
| 524 | Ac-TatAhxIWIAQELR$IED$FNAYYARR-NH2 |
| 525 | 5-FAM-TatAhxIWIAQELR$IED$FNAYYARR-NH2 |
| 526 | Ac-IWIAQHELRRIEDDFNAYYARR-NH2 |
| 527 | Ac-TatAhxIWIAQELRRIEDDFNAYYARR-NH2 |
| 528 | 5-FAM-TatAhxIWIAQELRRIRDDFNAYYARR-NH2 |
| 529 | Ac-IWIAQELR$/IED$/FNAYYARR-NH2 |
| 530 | 5-FAM-AhxIWIAQELR$/IED$/FNAYYARR-NH2 |
| 531 | 5-FAM-AhxIWIAQAAR$DIGSANAYYARR-NH2 |
| 532 | Ac-TatAhxIWIAQAAR$DIG$ANAYYARR-NH2 |
| 533 | 5-FAM-TatAhxIWIAQAAR$DIG$ANAYYARR-NH2 |
| 534 | Ac-IWIAQAARRDIGEANAYYARR-NH2 |
| 535 | Ac-TatAhxIWIAQAARRDIGEANAYYARR-NH2 |
| 536 | 5-FAM-TatAhxIWIAQAARRDIGEANAYYARR-NH2 |
| 537 | Ac-IWIAQAAR$DIG$ANAYYARR-NH2 |
| 538 | 5-FAM-AhxIWIAQAAR$/DIG$/ANAYYARR-NH2 |
| 539 | AC-IWIAQELRRIEDEFNAYYARR-N1I2 |
| 540 | Ac-IWIAQALR$/IGD$/FNAFYARR-NH2 |
| 541 | Ac-RWIAQALR$IGD$FNAFYAHH-NH2 |
| 542 | TatAhxIWIAQELRRIGDEFNAYYARR-NH2 |
| 543 | 5-FAM-TatAhxIWIAQELRRIEDEFNAYYARR-NH2 |
| 544 | Ac-IWIAQALRRI$DKF$AYYARR-NH2 |
| 545 | Ac-IWIAQALR$r8IGDEFN$YYARR-NH2 |

TABLE 1-continued

| SEQ ID NO | Peptide sequence |
|---|---|
| 546 | AC-IWIAQELRRIEDEFNAYYARR-NH2 |
| 547 | Ac-IWIAQELR$/IED$/FNAYYARR-NH2 |
| 548 | AC-IWIAQAARRDIGEANAYYARR-NH2 |
| 549 | Ac-IWIAQAAR$/DIG$/ANAYYARR-NH2 |
| 550 | Ac-IWIAQALR$/IGD$/FNAFYARR-NH2 |
| 551 | Ac-RWIAQALR$IGD$FNAFYAHH-NH2 |
| 552 | Ac-IWIAQALRRIGDEFNAFYARR-NH2 |
| 553 | 5-FAM-AhxIWIAQALR$r8IGDEFN$YYARR-NH2 |
| 554 | Ac-RWIAQALR$IGD$FNA-OH |
| 555 | Ac-RWIAQALR$IGD$FNAFYA-OH |
| 556 | Ac-RWIAQALR$IGD$FNAF-OH |
| 557 | Ac-RWIAQALR$IGD$FNAFYARAmr-NH2 |
| 558 | 5-FAM-AhxIWIAQALR$/r8IGDEFN$/YYARR-NH2 |
| 559 | Ac-IWIAQALR$/r8IGDEFN$/YYARR-NH2 |
| 560 | OVA-CAhxIWIAQALR$IGD$FNAYYARR-NH2 |
| 561 | Ac-IWIA$ALR$IGDEFNAYYARR-NH2 |
| 562 | Ac-IWIA$/ALR$/IGDEFNAYYARR-NH2 |
| 563 | 5-FAM-AhxIWIA$/r5ALRSt//IGD$/FNAYYARR-NH2 |
| 564 | 5-FAM-AhxIWIA$ALRStIGDEFN$s8YYARR-NH2 |
| 565 | HepIAQ$LR$IGD$FNAYYARRTag5-FAM |
| 566 | 5-FAM-AhxIWIA$/ALRSt//IGDEFN$/s8YYARR-NH2 |
| 567 | 5-FAM-AhxIWIA$r5ALRStIGD$FNAYYARR-NH2 |
| 568 | Ac-AAARAAARAAA$AAA$AAAAA-NH2 |
| 569 | Ac-AAAAAAAR$AAA$AAAAAARA-NH2 |
| 570 | Ac-AAARAAARAAAKAAAEAAAAA-NH2 |
| 571 | Ac-AAAAAAARKAAAEAAAAAARA-NH2 |
| 572 | Ac-AAARAAAAAARAAAAA-NH2 |
| 573 | Ac-IWIAQELR%OIGD%OFNAYYARR-NH2 |
| 574 | Ac-IWIA$/r5ALRSt//IGD$/FNAYYARR-NH2 |
| 575 | Ac-IWIA$/ALRSt//IGDEFN$/s8YYARR-NH2 |
| 576 | Ac-I$r8IAQALR$IGDEFNAYYARR-NH2 |
| 577 | Ac-IWIAQALRRIG$r8EFNAYY$RR-NH2 |
| 578 | Ac-I$/r8IAQALR$/IGDEFNAYYARR-NH2 |
| 579 | Ac-IWIAQALRRIG$/r8EFNAYY$/RR-NH2 |
| 580 | Ac-RWIAQALR$IGD$FNAFYAibRR-NH2 |
| 581 | Ac-RWIAQALR$IGD$FNASYARR-NH2 |
| 582 | Ac-RWIAQALR$r5IGD$r5FNAFYARR-NH2 |
| 583 | Ac-IWIAQALRRIGDEF$AYY$RR-NH2 |
| 584 | Ac-RWIAEALR$IGD$FNAFYARR-NH2 |
| 585 | Ac-RWIAEALR$IGD$FDAFYARR-NH2 |
| 586 | Ac-RWIAQALR$/r5IGD$/FNAFYARR-NH2 |
| 587 | Ac-RWIAQALR$/IGD$/r5FNAFYARR-NH2 |
| 588 | Ac-IWIAQALRRIG$EFN$YYARR-NH2 |
| 589 | Ac-IWIAQALRRIGD$FNA$YARR-NH2 |
| 590 | Ac-IWIAQALRRIGDE$NAY$ARR-NH2 |
| 591 | Ac-IWIAQALRRIGD$r8FNAYYA$R-NH2 |
| 592 | %HepIAQ%LR%IGD%FNAYYARR-NH2 |
| 593 | Ac-SYDDALLMLRSIGDSL-NH2 |
| 594 | Ac-TEMMLAIMLRGIGDSL-NH2 |
| 595 | Ac-WVSEFLAIGDYVDFHY-NH2 |
| 596 | Ac-DLPVFILRNIGDSLIG-NH2 |
| 597 | Ac-VSDFDDFLTSVLDIYL-NH2 |
| 598 | 5-FAM-AhxIWIA$ALR$IGDEFNAYYARR-NH2 |
| 599 | 5-FAM-AhxIWIAQALRRIGDEF$AYY$RR-NH2 |
| 600 | 5-FAM-AhxI$IAQ$LRRIGDEFNAYYARR-NH2 |
| 601 | 5-FAM-AhxI$IAQ$LR$IGD$FNAYYARR-NH2 |
| 602 | 5-FAM-AhxIWIAQALRRIG$EFN$YYARR-NH2 |
| 603 | 5-FAM-AhxIWIAQALRRIGD$FNA$YARR-NH2 |
| 604 | 5-FAM-AhxIWIAQALRRIGDE$NAY$ARR-NH2 |
| 605 | 5-FAM-AhxI$r8IAQALR$IGDEFNAYYARR-NH2 |
| 606 | 5-FAM-AhxIWIAQALRRIGD$r8FNAYYA$R-NH2 |
| 607 | 5-FAM-AhxIWIAQALRRIGD$r8FNAYYA$R-NH2 |
| 608 | Ac-RWIAQALR$IGD$FDAFYARR-NH2 |
| 609 | Ac-IWIA$ALRStIGD$r5FNAYYARR-NH2 |
| 610 | Ac-IWIAQALR$IGDStFNA$r5YARR-NH2 |
| 611 | Ac-RWIA$ALRStIGD$r5FNAFYARR-NH2 |
| 612 | Ac-RWIAQALR$IGDStFNA$r5YARR-NH2 |
| 613 | Ac-TENleNleLAINleLR$IGD$L-NH2 |
| 614 | Ac-WVSEFL$IGD$VDFHY-NH2 |
| 615 | Ac-DLPVFILR$IGD$L1G-NH2 |
| 616 | Ac-VSDFDDFLT$VLD$YL-NH2 |
| 617 | Ac-RWIAQALR$trIGD$trFNAFYARR-NH2 |
| 618 | Ac-RWIAQALR$r5IGDStFNA$YARR-NH2 |
| 619 | Ac-RWIAQALR$IGD$FNAibFYARR-NH2 |
| 620 | Ac-RWIAQALR$IGD$FNAibFYAibRR-NH2 |
| 621 | Ac-PEG3RWIAQALR$IGD$FNAFYARR-NH2 |

TABLE 1-continued

| SEQ ID NO | Peptide sequence |
|---|---|
| 622 | Ac-RWIAQALR$IGD$FNAFYAibHH-NH2 |
| 623 | Ac-RWIAQALR$IGD$FNAibFYAHH-NH2 |
| 624 | Ac-RWIAQALR$IGD$FNAibFYAibHH-NH2 |
| 625 | Ac-RWIAQALR$IGD$FNAAmfYAHH-NH2 |
| 626 | Ac-RWIAQALR$r5IGD$FNAFYARR-NH2 |
| 627 | Ac-RWIAQALR$IGD$r5FNAFYARR-NH2 |
| 628 | Ac-RWIAQALR$IGD$FNAFYARRPEG3-NH2 |
| 629 | Ac-RWIAQ$r8LRRIGDStFNAFYA$s8R-NH2 |
| 630 | Ac-R$r8IAQALRStIGDEFN$s8FYARR-NH2 |
| 631 | Ac-RWIAQALR$IGD$FNADamfYARR-NH2 |
| 632 | Ac-RWIAQALRbDIGDbKFNAFYARR-NH2 |
| 633 | Ac-RWIAQALRbKIGDbDFNAFYARR-NH2 |
| 634 | Ac-RWIAQALR$IAibD$FNAFYARR-NH2 |
| 635 | Ac-R$r5IGDStFNA$YARR-NH2 |
| 636 | Ac-RWIA$ALRStIGD$r5FNAAmfYARR-NH2 |
| 637 | Ac-RWIA$r5ALRStIGD$FNAAmfYARR-NH2 |
| 638 | Ac-IWIA$ALRStIGD$r5FNAAmfYARR-NH2 |
| 639 | Ac-IWIA$r5ALRStIGD$FNAAmfYARR-NH2 |
| 640 | Ac-RWIAQQLR$IGD$FNAFYAHH-NH2 |
| 641 | Ac-RWIAQALR#c4IGD#c4FNAFYARR-NH2 |
| 642 | Ac-RWIAQALR#c4eIGD#c4eFNAFYARR-NH2 |
| 643 | Ac-RWIAQLLR$IGD$FNAFYARR-NH2 |
| 644 | Ac-RWIAQALR$IGD$FNAhFYARR-NH2 |
| 645 | Ac-RWIAQALR$IGD$FNAAmfYAAmrR-NH2 |
| 646 | Biotin-IWIAQELR$IGD$FNAYYARR-NH2 |
| 647 | 5-FAM-AhxIWIA$/ALR$/IGDEFNAYYARR-NH2 |
| 648 | 5-FAM-AhxRWIAQALR$DIG$FNAFYARR-NH2 |
| 649 | Ac-RWIAQALR$IGD$FNAFYARR-OH |
| 650 | Ac-IWIAQALR$5a5IGD$5n3FNAYYARR-NH2 |
| 651 | Ac-RWIAQQFR$IGD$FNAYYARR-NH2 |
| 652 | Ac-RWIAQQLR$IGD$FNAFYAHR-NH2 |
| 653 | Ac-RWIAQQLR$IGD$FNAFYARH-NH2 |
| 654 | Ac-RWIAQQLRRIGDEFNAFYAHH-NH2 |
| 655 | Pr-WIAQQLR$IGD$FNAFYARR-NH2 |
| 656 | Ac-WIAQQLR$IGD$FNAYYAR-NH2 |
| 657 | Ac-WIAQQLR$IGD$FNAFYAR-NH2 |
| 658 | Ac-IWIAQELD$IGD$FNAYYARR-NH2 |
| 659 | Ac-RWIAQALD$IGD$FNAFYARR-NH2 |
| 660 | Ac-IWIAQLLR$IGD$FNAFYARR-NH2 |
| 661 | Ac-RWIAQQLR$IGD$INalNAYYARR-NH2 |
| 662 | Ac-RWIAQLLR$IGD$INalNAYYARR-NH2 |
| 663 | Ac-RWIAQALR$IGD$INalNAFYARR-NH2 |
| 664 | Ac-RWIAQALR$5n3IGD$5a5FNAFYARR-NH2 |
| 665 | Ac-RWIAQALR$5a5IGD$5n3FNAFYARR-NH2 |
| 666 | Ac-RWIAQALR$/n3IGD$/a5FNAFYARR-NH2 |
| 667 | Ac-RWIAQALR$/a5IGD$/n3FNAFYARR-NH2 |
| 668 | Pr-WIAQQLR$IGD$FNASYARR-NH2 |
| 669 | Pr-NIAQQLR$IGD$FNASYARR-NH2 |
| 670 | Pr-SIAQQLR$IGD$FNASYARR-NH2 |
| 671 | Pr-WIAQQLR$IGD$FNASYAR-NH2 |
| 672 | Ac-RWIAQNLR$IGD$FNAYYARR-NH2 |
| 673 | Ac-RWIAQRLR$IGD$FNAYYARR-NH2 |
| 674 | Pr-W1AQ$LRR$GDAFNASYARR-NH2 |
| 675 | Ac-RWIAQQLR$IGD$FNAYYAHR-NH2 |
| 676 | Ac-RWIAQQLR$IGD$FNAYYARH-NH2 |
| 677 | Ac-RWIAQQLR$IGD$FNAYYAHH-NH2 |
| 678 | Pr-WIAQQLR$IGD$FNASIARR-NH2 |
| 679 | Ac-IWIAQQLR$IED$FNAYYARR-NH2 |
| 680 | FITC-BaIWIAQELR$IGD$FNAYYARR-NH2 |
| 681 | FITC-BaIWIAQELD$IGD$FNAYYARR-NH2 |
| 682 | FITC-BaRWIAQALR$IGD$FNAFYARR-NH2 |
| 683 | FITC-BaRWIAQALD$IGD$FNAFYARR-NH2 |
| 684 | HBS-IWAarAQELRRIGDEFNAYYARR-NH2 |
| 685 | FITC-BaBaRWIAQALR$IGD$FNAFYARR-NH2 |
| 686 | 5-TAMRA-BaIWIAQELR$IGD$FNAYYARR-NH2 |
| 687 | 5-TAMRA-BaRWIAQALR$IGD$FNAFYARR-NH2 |
| 688 | 5-TAMRA-BaIWIAQELR$IED$FNAYYARR-NH2 |
| 689 | Ac-RWIAQQLR$IGD$FNASYARR-NH2 |
| 690 | Ac-RWIAQQLR$r5IGDStFNA$YARR-NH2 |
| 691 | Ac-RWIAQALR$IGD$FNAC13FYARR-NH2 |
| 692 | Ac-WIAQQLR$r5IGDStFNA$YARR-NH2 |
| 693 | Ac-RIAQELR$IGD$FNAYYAR-NH2 |
| 694 | Ac-RIAQQLR$IGD$FNAYYAR-NH2 |
| 695 | Ac-RWIA4QAL7R$IGD$FNAFYARR-NH2 |
| 696 | Ac-IWIAQELR#cIGR#cFNAYYARR-NH2 |
| 697 | Ac-IWIAQELR#cIGD#cFNAYYARR-NH2 |

TABLE 1-continued

| SEQ ID NO | Peptide sequence |
|---|---|
| 698 | Ac-IWIAQELR#5n3IGD#5a5FNAYYARR-NH2 |
| 699 | FITC-AhxIWIAQELR#5n3IGD#5a5FNAYYARR-NH2 |
| 700 | HepIAQ$LR$IGD$FNAFYARR-NH2 |
| 701 | IAQDprLRRIGDEFNAYYARR-NH2 |
| 702 | IAQDprLRRIGDQFNAYYARR-NH2 |
| 703 | WIADprALRRIGDEFNAYYARR-NH2 |
| 704 | WIADprALRRIGDQFNAYYARR-NH2 |
| 705 | HepIAQ$LR$IGD$FNAYYARRTag5-FAM- |
| 706 | Ac-TEN1eN1eLAIN1eLR$IGD$L-NH2 |
| 707 | 5-TAMRA-BaIWIAQELR$IGD$FNAYYARR-NH2 |
| 708 | Ac-RWIAQALR$IGD$FNAFYARR-NH2 |
| 709 | Ac-IWIAQELR#sIGD#sFNAYYARR-NH2 |
| 710 | Ac-IWIAQELR#sIAibD#sFNAYYARR-NH2 |
| 711 | Ac-IWIAQELR$sIGD$sFNAYYARR-NH2 |
| 712 | HepIAQ$LR$IGD$FNAYYARR-NH2 |
| 713 | Ac-RWIAQALR$IGD$VNAFYARR-NH2 |
| 714 | Pr-WIAQQLR$IGD$VNAFYARR-NH2 |
| 715 | Ac-RWIAQALR$IGD$VNASYARR-NH2 |
| 716 | Ac-RWIAQQLR$IGD$VNAFYARR-NH2 |
| 717 | Ac-RWIAQQLR$IGD$VNASYARR-NH2 |
| 718 | Ac-RWIAQALR$IGD$LNAFYARR-NH2 |
| 719 | Ac-RWIAQQLR$IGD$LNAFYARR-NH2 |
| 720 | Ac-KALETLRRVGDGV$RNH$TA-NH2 |
| 721 | Pr-WIAQQLR$IGD$VNAFYARR-NH2 |
| 722 | Pr-WIAQQLR$IGD$VNASYARR-NH2 |
| 723 | Ac-RWIAQQLR$IGD$VNAFYAHH-NH2 |
| 724 | Pr-WIAQQLR$IGD$VNAFYAR-NH2 |
| 725 | Pr-WIAQQLR$IGD$FNAFYAHH-NH2 |
| 726 | Pr-WIAQQLR$IGD$FNAFYARH-NH2 |
| 727 | Pr-WIAQQLR$IGD$FNAFYAHR-NH2 |
| 728 | Ac-RWIA4QAL7R$IGD$FNAFYARR-NH2 |
| 729 | Pr-WIAQQLR$IGD$LNAYYARR-NH2 |
| 730 | Pr-WIAQQLR$IGD$LNASYARR-NH2 |
| 731 | Pr-WIAQQLR$IGD$LNAYYARH-NH2 |
| 732 | Pr-WIAQQLR$IGD$LNAYYAHR-NH2 |
| 733 | Pr-RIAQQLR$IGD$LNAYYARH-NH2 |
| 734 | Pr-RIAQQLR$IGD$LNAYYAHR-NH2 |
| 735 | Pr-RIAQQLR$IGD$LNAYYAHH-NH2 |
| 736 | Pr-SIAQQLR$IGD$LNAYYARR-NH2 |
| 737 | Pr-AibIAQQLR$IGD$LNAYYARR-NH2 |
| 738 | Pr-YIAQQLR$IGD$LNAYYARR-NH2 |
| 739 | Pr-RIAQQLR$IGD$LNAYYAR-NH2 |
| 740 | Ac-RSIAQQLR$IGD$LNAYYARR-NH2 |
| 741 | Ac-IWIAQELR$r5IGDStFNA$YARR-NH2 |
| 742 | Pr-SIAQQLR$r5IGDStFNA$YARR-NH2 |
| 743 | Ac-RWIA$r5ALRStDIL$FNAFYARR-NH2 |
| 744 | Ac-RWIAQALR$5a5DIL$5n3FNAFYARR-NH2 |
| 745 | Ac-RWIAQQLR$IGD$FNAYYAH-NH2 |
| 746 | Ac-RWIA$r5ALRStIDL$FNAFYARR-NH2 |
| 747 | Ac-RWIAQALR$5a5ILL$5n3FNAFYARR-NH2 |
| 748 | Pr-RIAQQLR$IGD$FNAYYAHH-NH2 |
| 749 | Pr-WIAQQLR$IGD$VNAYYAHR-NH2 |
| 750 | Pr-WIAQQLR$IGD$VNAFYAHR-NH2 |
| 751 | Pr-RIAQQLR$IGD$VNAYYAHR-NH2 |
| 752 | Ac-RWIAQALR$5n3DIL$5a5FNAFYARR-NH2 |
| 753 | Ac-R$r8IAQALRStIGDLFN$s8FYARR-NH2 |
| 754 | Pr-RIAQQLR$IGD$FNAYYAH-NH2 |
| 755 | Ac-RWIAQALR$5n3ILL$5a5FNAFYARR-NH2 |
| 756 | Ac-RAIAQQLR$IGD$FNAYYAH-NH2 |
| 757 | Pr-WIAQQLR$IGD$LNAYYAHH-NH2 |
| 758 | Pr-SIAQQLR$IGD$LNAYYAHR-NH2 |
| 759 | Ac-RWIAQQLR$IGD$VNAFYAHR-NH2 |
| 760 | Ac-IWIA$QLRStIGD$r5FNAYYARR-NH2 |
| 761 | Ac-RWIA$QLRStIGD$r5FNAYYARR-NH2 |
| 762 | Ac-RWIAQQLR$IGD$FNAibFYAHH-NH2 |
| 763 | Ac-RWIAQALR$IGD$LNAibFYAHH-NH2 |
| 764 | Ac-IWIA$ALRStIGD$r5LNAYYARR-NH2 |
| 765 | Ac-IWIAQALR$IGDStFNA$r5YAHH-NH2 |
| 766 | Ac-RWIA$ALRStIGD$r5FNAYYARR-NH2 |
| 767 | Pr-WIAQQLR$IGD$FNAYYAHH-NH2 |
| 768 | Pr-SIAQQLR$IGD$FNAFYARR-NH2 |
| 769 | Ac-WIAQQLR$IGD$FNAibFYAHH-NH2 |
| 770 | Ac-RWIAQALR$IGD$VNAibFYAHH-NH2 |
| 771 | Ac-IWIAQQLR$IGD$FNAibFYAHH-NH2 |
| 772 | Ac-IWIAQALR$IGD$VNAibFYAHH-NH2 |
| 773 | Ac-IWIAQALR$IGD$LNAibFYAHH-NH2 |

TABLE 1-continued

| SEQ ID NO | Peptide sequence |
|---|---|
| 774 | Ac-ELR$r5IGDStFNA$YARR-NH2 |
| 775 | Ac-QELR$r5IGDStFNA$YARR-NH2 |
| 776 | Ac-AQELR$r5IGDStFNA$YARR-NH2 |
| 777 | Ac-IAQELR$r5IGDStFNA$YARR-NH2 |
| 778 | Ac-RWIAQALR$r5IGDStFNA$YAHH-NH2 |
| 779 | Ac-RWIAQQLR$r5IGDStFNA$YAHH-NH2 |
| 780 | Ac-RWIAQALR$IGDStFNA$r5YAHH-NH2 |
| 781 | Ac-RWIAQQLR$IGDStFNA$r5YAHH-NH2 |
| 782 | Ac-IWIAQQFR$IGD$FNAYYARR-NH2 |
| 783 | Ac-RWIAQQFR$IGD$FNAFYAHH-NH2 |
| 784 | Ac-IWIAQALR$IGD$FNAibFYAHH-NH2 |
| 785 | Ac-RWIAQQLR$IGD$FNAibYYAHH-NH2 |
| 786 | Ac-IWIAQALR$IGD$FNAibYYAHH-NH2 |
| 787 | Ac-RWIAQALR$IGD$FNAibYYAHH-NH2 |
| 788 | Ac-RWIAQALR$IGD$LNAibYYAHH-NH2 |
| 789 | Ac-RIAQQLR$IGD$FNAibFYAHH-NH2 |
| 790 | Pr-WIAQQLR$IGD$FNAibYYAHH-NH2 |
| 791 | Pr-RIAQQLR$IGD$FNAibYYAHH-NH2 |
| 792 | Pr-NIAQQLR$IGD$FNAibFYAHH-NH2 |
| 793 | Pr-SIAQQLR$IGD$FNAibFYAHH-NH2 |
| 794 | Pr-NIAQQLR$IGD$FNAibYYARR-NH2 |
| 795 | Pr-SIAQQLR$IGD$FNAibYYARR-NH2 |
| 796 | Ac-IWIA$r5QLRStIGD$FNAYYARR-NH2 |
| 797 | Ac-IWIA$ALDStIGD$r5FNAYYARR-NH2 |
| 798 | Ac-RWIAQALD$IGD$FNAibFYAHH-NH2 |
| 799 | Ac-RWIAQQLR$IGD$LNAibFYAHH-NH2 |
| 800 | Ac-IWIAQQLR$IGD$LNAibFYAHH-NH2 |
| 801 | Ac-RAIAQQLR$IGD$LNAibFYAHH-NH2 |
| 802 | Ac-IRIAQQLR$IGD$LNAibFYAHH-NH2 |
| 803 | Ac-RAIAQQLR$IGD$FNAibFYAHH-NH2 |
| 804 | Ac-IRIAQQLR$IGD$FNAibFYAHH-NH2 |
| 805 | Ac-RWIAQALR$IGA$FNAibFYAHH-NH2 |
| 806 | Ac-RWIAQQLR$IGA$FNAFYAHH-NH2 |
| 807 | Pr-RIAQQLR$IGD$FNAibFYAHH-NH2 |
| 808 | Pr-WIAQQLR$IGD$FNAibFYAHH-NH2 |
| 809 | Ac-RWIAQALR$IGD$INAibFYAHH-NH2 |
| 810 | Ac-RWIAQALR$IGD$ChgNAibFYAHH-NH2 |
| 811 | Ac-IWIAQQLR$IGD$VNAibFYAHH-NH2 |
| 812 | Ac-IWIAQQLR$IGD$INAibFYAHH-NH2 |
| 813 | Ac-RWIAQQLR$IGD$VNAibFYAHH-NH2 |
| 814 | Ac-RWIAQQLR$IGD$INAibFYAHH-NH2 |
| 815 | Pr-WIAQQLR$IGD$VNAibFYAHH-NH2 |
| 816 | Ac-RWIAQAFR$IGD$VNAibFYAHH-NH2 |
| 817 | Ac-RWIAQANleR$IGD$VNAibFYAHH-NH2 |
| 818 | Ac-RWIAQAChgR$IGD$VNAibFYAHH-NH2 |
| 819 | Ac-RWIAQALR$IGD$LNAFYAibHH-NH2 |
| 820 | Ac-RWIAQALR$IGD$VNAFYAibHH-NH2 |
| 821 | Ac-RWIAQALD$IGD$FNAibYYAHH-NH2 |
| 822 | Ac-RWIA$r5ALRStIGD$FNAYYARR-NH2 |
| 823 | Ac-IWIA$r5ALDStIGD$FNAYYARR-NH2 |
| 824 | Ac-IWIA$r5ALRStIGD$FNAYYAibRR-NH2 |
| 825 | Ac-IWIA$r5ALRStIGD$VNAYYARR-NH2 |
| 826 | Ac-IRIAQALR$IGD$FNAibFYAHH-NH2 |
| 827 | Ac-INIAQALR$IGD$FNAibFYAHH-NH2 |
| 828 | Ac-IFIAQALR$IGD$FNAibFYAHH-NH2 |
| 829 | Ac-ISIAQALR$IGD$FNAibFYAHH-NH2 |
| 830 | Ac-IAibIAQALR$IGD$FNAibFYAHH-NH2 |
| 831 | Ac-IWNleAQALR$IGD$FNAibFYAHH-NH2 |
| 832 | Ac-IWIAQANleR$IGD$FNAibFYAHH-NH2 |
| 833 | Ac-IWIAibQALR$IGD$FNAibFYAHH-NH2 |
| 834 | Pr-IAQALR$IGD$FNAibFYAHH-NH2 |
| 835 | Ac-IWIAQAibLR$IGD$FNAibFYAHH-NH2 |
| 836 | Ac-IWIAQLLR$IGD$FNAibFYAHH-NH2 |
| 837 | Ac-IWIAQFLR$IGD$FNAibFYAHH-NH2 |
| 838 | Ac-IAIAAFLR$IGD$FNAibFYA-NH2 |
| 839 | Ac-IWIAQALR$IGD$FNAibYYAibHH-NH2 |
| 840 | Ac-IWIAQALR$IGD$FAAibFYAHH-NH2 |
| 841 | Ac-RWIAQALR$r8IGDAibFN$FYAHH-NH2 |
| 842 | Ac-RWIAQALR$r8IGDAFN$FYAHH-NH2 |
| 843 | Ac-RWIA$r8ALRAibIG$AFNAibYYAHH-NH2 |
| 844 | Ac-RWIA$r8ALRAIG$AFNAibYYAHH-NH2 |
| 845 | Ac-IWIAQALR$IGD$ChaNAibFYAHH-NH2 |
| 846 | 5-FAM-BaIWIAQALR$IGD$FNAibFYAHH-NH2 |
| 847 | 5-FAM-BaRWIAQALR$IGD$LNAibFYAHH-NH2 |
| 848 | Ac-IWILQALR$IAibD$FNAibFYAHH-NH2 |
| 849 | Ac-IAIAQFLR$IGD$FNAibFYAHH-NH2 |

TABLE 1-continued

| SEQ ID NO | Peptide sequence |
|---|---|
| 850 | Ac-IWIAQALR$r8IGDAFN$FYAHH-NH2 |
| 851 | Ac-IWIAQALR$r8IGDAibFN$FYAHH-NH2 |
| 852 | Ac-IWIAQNLR$IGD$FNAibFYAHH-NH2 |
| 853 | Ac-IWIAQHLR$IGD$FNAibFYAHH-NH2 |
| 854 | Ac-RWIAAQLR$IGD$FNAibFYA-NH2 |
| 855 | Ac-RNIAQALR$IGD$FNAibFYAHH-NH2 |
| 856 | Ac-RFIAQALR$IGD$FNAibFYAHH-NH2 |
| 857 | Ac-RAibIAQALR$IGD$FNAibFYAHH-NH2 |
| 858 | Ac-RAIAQFLR$IGD$FNAibFYAHH-NH2 |
| 859 | Ac-RWIAQLLR$IGD$FNAibFYAHH-NH2 |
| 860 | Ac-RWIAQFLR$IGD$FNAibFYAHH-NH2 |
| 861 | Ac-RWIAQAibLR$IGD$FNAibFYAHH-NH2 |
| 862 | Ac-RWIAQALR$IGD$FNAibFYQHH-NH2 |
| 863 | Ac-RWIAQHLR$IGD$FNAibFYAHH-NH2 |
| 864 | Ac-RWIAQALR$NleGD$FNAibFYAHH-NH2 |
| 865 | Pr-IAQLLR$IGD$FNAibFYAHH-NH2 |
| 866 | Ac-RWIALALR$IGD$FNAibFYAHH-NH2 |
| 867 | Pr-WIALALR$IGD$FNAibFYAHH-NH2 |
| 868 | Ac-RAIAFALR$IGD$FNAibFYAHH-NH2 |
| 869 | Ac-WIAQALR$IGD$FNAibFYQHH-NH2 |
| 870 | Ac-CCPGCCBaIWIAQALR$IGD$FNAibFYAHH-NH2 |
| 871 | Ac-CCPGCCBaRWIAQALR$IGD$VNAibFYAHH-NH2 |
| 872 | Ac-CCPGCCBaRWIAQALR$IGD$LNAibFYAHH-NH2 |
| 873 | Ac-IWIAQALR$IGD$FNAibFYQHH-NH2 |
| 874 | Ac-RWIAQAibLR$r5IGDStFNA$YAHH-NH2 |
| 875 | Ac-IWIAQLLR$IGD$FNAibFYQHH-NH2 |
| 876 | Ac-RWIAQALR$IGD$FNRFYAHH-NH2 |
| 877 | Ac-RWIAQALR$IGD$FNAFYRHH-NH2 |
| 878 | Ac-RWIAQRLR$IGD$FNAFYAHH-NH2 |
| 879 | Ac-RWIAQALR$IGD$FNARYAHH-NH2 |
| 880 | Ac-RWIAERLR$IGD$FNAFYAHH-NH2 |
| 881 | Ac-RWIAQALR$IGD$FNQFYAHH-NH2 |
| 882 | Ac-RWIAQALR$IGD$FNAFYQHH-NH2 |
| 883 | Ac-RWIAQELR$IGD$FNARYAHH-NH2 |
| 884 | Ac-RWIAQALR$IGD$FNAQYAHH-NH2 |
| 885 | Ac-RWIAQQLR$IGD$QNQQYQHH-NH2 |
| 886 | Ac-IWIAAFLR$IGD$FNAibFYAHH-NH2 |
| 887 | Ac-IWIAQALR$IGD$FNleAibFYAHH-NH2 |
| 888 | Ac-IWIAQALR$IGD$FNleAibFYQHH-NH2 |
| 889 | Ac-IWIAQAibLR$IGD$VNAibFYAHH-NH2 |
| 890 | Ac-IWIAQLLR$IGD$VNAibFYAHH-NH2 |
| 891 | Ac-IWIAQAAR$IGD$VNAibFYAHH-NH2 |
| 892 | Ac-IAIAFALR$IGD$VNAibFYAHH-NH2 |
| 893 | Ac-IWIALALR$IGD$VNAibFYAHH-NH2 |
| 894 | Ac-IWIAQALR$IGD$VNAibFYQHH-NH2 |
| 895 | Ac-IWIAQELR$4n4IGD$4a3FNAYYARR-NH2 |
| 896 | Ac-IWIAQELR$4a3IGD$4n4FNAYYARR-NH2 |
| 897 | Ac-IWIAQELR$4n3IGD$4a5FNAYYARR-NH2 |
| 898 | Ac-IWIAQELR$4a5IGD$4n3FNAYYARR-NH2 |
| 899 | Ac-IWIAQELR$4n5IGD$4a5FNAYYARR-NH2 |
| 900 | Ac-IWIAQELR$4a5IGD$4n5FNAYYARR-NH2 |
| 901 | Ac-RCouIAQALR$IGD$LNAibFYAHH-NH2 |
| 902 | Ac-RCouIAQALR$r5IGDStFNA$YAHH-NH2 |
| 903 | Ac-ICouIAQALRRIGDELNAibFYAHH-NH2 |
| 904 | Ac-RCouIAQALRRIGDEFNAFYAHH-NH2 |
| 905 | Ac-IWIAQALR$IGD$FNAFYAibHH-NH2 |
| 906 | Ac-IWIALALR$IGD$FNAibFYAHH-NH2 |
| 907 | Ac-IAIAFALR$IGD$FNAibFYAHH-NH2 |
| 908 | Ac-RWIAQHLR$IGD$VNAibFYAHH-NH2 |
| 909 | Ac-IWIAQHLR$IGD$VNAibFYAHH-NH2 |
| 910 | Ac-RWIAQLLR$IGD$VNAibFYAHH-NH2 |
| 911 | Ac-IWIAQLLR$IGD$VNAibFYAHH-NH2 |
| 912 | Ac-IWIAQFLR$IGD$VNAibFYAHH-NH2 |
| 913 | Ac-IWIAQALR$IGD$HNAibFYAHH-NH2 |
| 914 | Ac-IWIAHLLR$IGD$VNAibFYAHH-NH2 |
| 915 | Ac-IWIAQALR$IGD$INAibFYAHH-NH2 |
| 916 | Ac-IWIAQLLR$IGD$INAibFYAHH-NH2 |
| 917 | Ac-IHIAQLLR$IGD$FNAibFYAHH-NH2 |
| 918 | Ac-IHIAQLLR$IGD$VNAibFYAHH-NH2 |
| 919 | Ac-IWIAQLLR$IGD$VNAibFYAHA-NH2 |
| 920 | Ac-IWIAQLLR$IGD$VNAibFYAAH-NH2 |
| 921 | Ac-RWIAQALD$IGR$VNAibFYAHH-NH2 |
| 922 | Ac-RWIAQALD$IGD$VNAibFYAHH-NH2 |
| 923 | Ac-IWIAQALD$IGR$VNAibFYAHH-NH2 |
| 924 | Ac-RWIAQAAR$IAibD$VNAibFYAHH-NH2 |
| 925 | Ac-IWIAQALD$IGR$FNAibFYAHH-NH2 |

TABLE 1-continued

| SEQ ID NO | Peptide sequence |
|---|---|
| 926 | Ac-IWIAQALD$IGD$FNAibFYAHH-NH2 |
| 927 | Ac-IWIAQAAR$IAibD$FNAibFYAHH-NH2 |
| 928 | Ac-RWIAQALD$r5IGRStFNA$YAHH-NH2 |
| 929 | Ac-IWIAQALR$r5IGDStFNA$YAHH-NH2 |
| 930 | Ac-RWIAAQLR$IGD$VNAibFYAHH-NH2 |
| 931 | Ac-IWIAAQLR$IGD$FNAibFYAHH-NH2 |
| 932 | Ac-IWNleAQLLR$IGD$FNAibFYAHH-NH2 |
| 933 | Ac-RWNleAQLLR$IGD$VNAibFYAHH-NH2 |
| 934 | Ac-IWNleAibQLLR$IGD$FNAibFYAHH-NH2 |
| 935 | Ac-RWNleAibQLLR$IGD$VNAibFYAHH-NH2 |
| 936 | Ac-IRIAQLLR$IGD$FNAibFYAHH-NH2 |
| 937 | Ac-ISIAQLLR$IGD$FNAibFYAHH-NH2 |
| 938 | Ac-IRIAibQLLR$IGD$FNAibFYAHH-NH2 |
| 939 | Ac-ISIAibQLLR$IGD$FNAibFYAHH-NH2 |
| 940 | Ac-IWIA$r5ALDStIGR$FNAYYARR-NH2 |
| 941 | Pr-WIAibQLLR$IGD$FNAibFYAibHH-NH2 |
| 942 | Ac-IWIAibQLLR$IGD$VNAibFYAibHH-NH2 |
| 943 | Pr-WIAQLLR$IGD$VNAibFYAibHH-NH2 |
| 944 | Pr-WIAibQALR$IGD$FNAibFYAibHH-NH2 |
| 945 | Ac-IWIAibQALR$IGD$VNAibFYAibHH-NH2 |
| 946 | Ac-RWIAibQALR$IGD$VNAibFYAibHH-NH2 |
| 947 | Ac-IWIAQAibLR$IGD$FNAibFYAibHH-NH2 |
| 948 | Ac-IWIAQAibLR$IGD$VNAibFYAibHH-NH2 |
| 949 | Ac-RWIAQAibLR$IGD$VNAibFYAibHH-NH2 |
| 950 | Ac-IWIAQALR$IGD$VNAibFYAibHH-NH2 |
| 951 | FITC-BaIWIAQELR$IGD$F |
| 952 | Ac-I$IAQ$LRRIGDEF$AYY$R-NH2 |
| 953 | Ac-I$IAQ$LRNleIGDNleF$AYY$R-NH2 |
| 954 | Ac-I$IAQ$LRRIGDEF$AYY$HH-NH2 |
| 955 | Ac-I$IAQ$LRNleIGDNleF$AYY$HH-NH2 |
| 956 | Ac-IWIA$ALR$IGD$FNA$YARR-NH2 |
| 957 | Ac-IWIA$ALR$IGD$FNA$YAHH-NH2 |
| 958 | Ac-IWIA$ALR$IGD$FNA$YAR-NH2 |
| 959 | Ac-IWIAQ$LRA$GDAFNAYYAR-NH2 |
| 960 | Ac-IWIAQ$LRA$GDAFNAYYAHH-NH2 |
| 961 | Ac-IWIAQALR$r8IGDAFN$YYARR-NH2 |
| 962 | Ac-IWIAQALR$r8IGDNleFN$YYARR-NH2 |
| 963 | Ac-IWIAQALR$r8IGDAibFN$YYARR-NH2 |
| 964 | Ac-IWIAQALR$r8IGDAFN$YYAHH-NH2 |
| 965 | Ac-IWIAQALR$r8IGDNleFN$YYAHH-NH2 |
| 966 | Ac-IWIAQALR$r8IGDAibFN$YYAHH-NH2 |
| 967 | Ac-IWIAQALR$r8IGDAFN$YYAR-NH2 |
| 968 | Ac-ICouIAQQLR$IGD$FNAibFYAHH-NH2 |
| 969 | Ac-ICouIAQALR$IGD$FNAibFYAHH-NH2 |
| 970 | Ac-ICouIAQELR$IGD$FNAibFYAHH-NH2 |
| 971 | Ac-ICouIAQALD$IGR$FNAibFYAHH-NH2 |
| 972 | Ac-ICouIAQALR$IGD$FNAibFYAAA-NH2 |
| 973 | Ac-ICouIAQALR$IGD$FNAibFYA-NH2 |
| 974 | Ac-RCou2IAQALR$r5IGDStFNA$YAHH-NH2 |
| 975 | Ac-RCou2IAQQLR$r5IGDStFNA$YAHH-NH2 |
| 976 | Ac-RCou2IAQALR$IGD$LNAibFYAHH-NH2 |
| 977 | Ac-ICou2IAQALR$IGD$FNAibFYAHH-NH2 |
| 978 | Ac-ICou2IAQQLR$IGD$FNAibFYAHH-NH2 |
| 979 | Ac-RWIAQALR$5rn3IGDSta5FNA$5n3YAHH-NH2 |
| 980 | Ac-RCou3IAQALR$r5IGDStFNA$YAHH-NH2 |
| 981 | Ac-RCou3IAQQLR$r5IGDStFNA$YAHH-NH2 |
| 982 | Ac-RCou3IAQALR$IGD$LNAibFYAHH-NH2 |
| 983 | Ac-ICou3IAQALR$IGD$FNAibFYAHH-NH2 |
| 984 | Ac-ICou3IAQQLR$IGD$FNAibFYAHH-NH2 |
| 985 | Ac-IWIAQALR$IGD$FNAibFYAAA-NH2 |
| 986 | Ac-IWIAQELR$IGD$FNAibFYAHH-NH2 |
| 987 | Ac-IWIAQALR$r8IGAAibFN$FYAHH-NH2 |
| 988 | Ac-IWIAQALR$IGD$FNAibFYA-NH2 |
| 989 | Ac-ICou2IA$ALRStIGD$r5FNAYYARR-NH2 |
| 990 | Ac-IDprIA$ALRStIGD$r5FNAYYARR-NH2 |
| 991 | Ac-ICou2IA$QLRStIGD$r5FNAYYARR-NH2 |
| 992 | Ac-IDprIA$QLRStIGD$r5FNAYYARR-NH2 |
| 993 | Ac-IWIAQQLR$r5IGDStFNA$YAHH-NH2 |
| 994 | Ac-ICou2IAQQLR$r5IGDStFNA$YAHH-NH2 |
| 995 | Ac-IDprIAQQLR$r5IGDStFNA$YAHH-NH2 |
| 996 | Ac-RDprIAQQLR$r5IGDStFNA$YAHH-NH2 |
| 997 | Ac-IWIAQALR$IGD$FNAibCou2YAHH-NH2 |
| 998 | Ac-IWIAQALR$IGD$FNAibCou3YAHH-NH2 |
| 999 | Ac-IWIAQALR$IGD$FNAibDprYAHH-NH2 |
| 1000 | Ac-IRIAQALR$IGD$FNAibCou2YAHH-NH2 |
| 1001 | Ac-IRIAQALR$IGD$FNAibCou3YAHH-NH2 |

TABLE 1-continued

| SEQ ID NO | Peptide sequence |
|---|---|
| 1002 | Ac-IRIAQALR$IGD$FNAibDprYAHH-NH2 |
| 1003 | Ac-IAibIAQALR$IGD$FNAibCou2YAHH-NH2 |
| 1004 | Ac-IAibIAQALR$IGD$FNAibCou3YAHH-NH2 |
| 1005 | Ac-IAibIAQALR$IGD$FNAibDprYAHH-NH2 |
| 1006 | Ac-ICou2IAQALR$IGD$FAAibFYAHH-NH2 |
| 1007 | Ac-ICou3IAQALR$IGD$FAAibFYAHH-NH2 |
| 1008 | Ac-IDprIAQALR$IGD$FAAibFYAHH-NH2 |
| 1009 | Pam-IWIAQALR$IGD$FNAibFYAHH-NH2 |
| 1010 | Pam-ICou2IAQALR$IGD$FNAibFYAHH-NH2 |
| 1011 | Pam-ICou3IAQALR$IGD$FNAibFYAHH-NH2 |
| 1012 | Pam-IDprIAQALR$IGD$FNAibFYAHH-NH2 |
| 1013 | Ac-IWIAQALR$5n3IGD$5a5FNAibFYAHH-NH2 |
| 1014 | Ac-IWIAQALR$5a5IGD$5n3FNAibFYAHH-NH2 |
| 1015 | Ac-IWIAQALR$r8IGDAFN$YYARR-NH2 |
| 1016 | Ac-ICou2IAQELR$IGD$FNAibFYAHH-NH2 |
| 1017 | Ac-ICou2IAQALD$IGR$FNAibFYAHH-NH2 |
| 1018 | Ac-ICou2IAQALR$IGD$FNAibFYAAA-NH2 |
| 1019 | Ac-ICou2IAQALR$IGD$FNAibFYA-NH2 |
| 1020 | Ac-RCou2IAQQLR$IGD$FNAibFYAHH-NH2 |
| 1021 | Ac-RCou2IAQALR$IGD$FNAibFYAHH-NH2 |
| 1022 | Ac-RCou2IAQELR$IGD$FNAibFYAHH-NH2 |
| 1023 | Ac-RCou2IAQALD$IGR$FNAibFYAHH-NH2 |
| 1024 | Ac-RCou2IAQALR$IGD$FNAibFYAAA-NH2 |
| 1025 | Ac-RCou2IAQALR$IGD$FNAibFYA-NH2 |
| 1026 | Ac-IWIAQALR$r8IGAAibFN$FYAHH-NH2 |
| 1027 | Ac-IWIA$ALRStIGD$r5FNAYYARR-NH2 |
| 1028 | Pr-Cou2IAQALR$IGD$FNAibFYAHH-NH2 |
| 1029 | Pr-Cou2IAQALR$IGD$FNAibFYQHH-NH2 |
| 1030 | Ac-RWIAQELR$IGD$FNAibFYAHH-NH2 |
| 1031 | Ac-RWIAQALD$IGR$FNAibFYAHH-NH2 |
| 1032 | Ac-RWIAQALR$IGD$FNAibFYAAA-NH2 |
| 1033 | Ac-RWIAQALR$IGD$FNAibFYA-NH2 |
| 1034 | Ac-ICou2IAQALRRIGDEFNAYYAHH-NH2 |
| 1035 | Ac-ICou2IAQELR$IGD$FNAibFYAHH-NH2 |
| 1036 | Ac-ICou2IAQALD$IGR$FNAibFYAHH-NH2 |
| 1037 | Ac-ICou4IAQALR$r5IGDStFNA$YAHH-NH2 |
| 1038 | Ac-RCou4IAQALR$r5IGDStFNA$YAHH-NH2 |
| 1039 | Ac-ICou4IAQALR$IGD$FNAibFYAHH-NH2 |
| 1040 | Ac-ICou4IAQQLR$IGD$FNAibFYAHH-NH2 |
| 1041 | Ac-RCou4IAQALR$IGD$LNAibFYAHH-NH2 |
| 1042 | Ac-IWIAQALR$5a5IGD$5n3FNAibFYAHH-NH2 |
| 1043 | Ac-RWIAQALR$/rn3IGDSta/FNA$/n3YAHH-NH2 |
| 1044 | Ac-ICou2IA$r5ALRStIGD$FNAYYARR-NH2 |
| 1045 | Ac-ICou2IA$r5QLRStIGD$FNAYYARR-NH2 |
| 1046 | Ac-ICou4IA$r5ALRStIGD$FNAYYARR-NH2 |
| 1047 | Ac-ICou4IA$r5QLRStIGD$FNAYYARR-NH2 |
| 1048 | Ac-RCou2IAQALR$IGDStFNA$r5YAHH-NH2 |
| 1049 | Ac-RCou4IAQALR$IGDStFNA$r5YAHH-NH2 |
| 1050 | Ac-ICou7IAQQLR$r5IGDStFNA$YAHH-NH2 |
| 1051 | Ac-RCou7IAQQLR$r5IGDStFNA$YAHH-NH2 |
| 1052 | Ac-IWIAQALR$IGD$FNAibCou7YAHH-NH2 |
| 1053 | Ac-IRIAQALR$IGD$FNAibCou7YAHH-NH2 |
| 1054 | Ac-ICou2IAQQLR$r5IGDStFNA$YAHH-NH2 |
| 1055 | Ac-AAIAQALR$IGD$FNAibFYAHH-NH2 |
| 1056 | Ac-AAIAQALR$IGD$FNAibFYA-NH2 |
| 1057 | Ac-IWIAQALR$IGD$FNAibFYAAAAa-NH2 |
| 1058 | Ac-IWIAQALR$IGD$FNAibAAAAAa-NH2 |
| 1059 | Ac-IWIAQALR$IGD$FNAibFYAHHAAAAa-NH2 |
| 1060 | Ac-IWIAQALA$IGD$FNAibFYAHH-NH2 |
| 1061 | Ac-IWIAQALR$IGD$FAAibFYA-NH2 |
| 1062 | Ac-IWIALALR$IGD$FAAibFYA-NH2 |
| 1063 | Ac-IWIALALR$IGD$FNAibFYA-NH2 |
| 1064 | Ac-IWIALALR$IGD$FAAibFYAHH-NH2 |
| 1065 | Ac-IWIALALR$IGD$FAAAAA-NH2 |
| 1066 | Ac-IWIALALR$IGD$FNAAAA-NH2 |
| 1067 | Ac-IWIALLLR$IGD$FAAibFYAHH-NH2 |
| 1068 | Ac-IWIALLLR$IGD$FNAibFYAHH-NH2 |
| 1069 | Ac-IWIALLLR$IGD$FNAibFYA-NH2 |
| 1070 | Ac-IWIALLLR$IGD$FNAibFYAAAAAa-NH2 |
| 1071 | Ac-RWIALQLR$r5IGDStFNA$YAHH-NH2 |
| 1072 | Ac-RWIAQQLR$r5IGDStFNA$YA-NH2 |
| 1073 | Ac-RWIAQQLR$r5IGDStFNA$YAAa-NH2 |
| 1074 | Ac-RWIALQLR$r5IGDStFNA$YAAa-NH2 |
| 1075 | Ac-RCou2IALQLR$r5IGDStFNA$YAHH-NH2 |
| 1076 | Ac-RCou2IAQQLR$r5IGDStFNA$YA-NH2 |
| 1077 | Ac-RCou2IAQQLR$r5IGDStFNA$YAAa-NH2 |

TABLE 1-continued

| SEQ ID NO | Peptide sequence |
|---|---|
| 1078 | Ac-RCou2IALQLR$r5IGDStFNA$YAAa-NH2 |
| 1079 | Ac-RCou2IAQALR$5rn3IGDSta5FNA$5n3YAHH-NH2 |
| 1080 | RCou4IAQALR$5rn3IGDSta5FNA$5n3YAHH-NH2 |
| 1081 | 5-FAM-BaRWIAQALR$r5IGDStFNA$YAHH-NH2 |
| 1082 | Ac-RCou2IAQQLRAibIGDAibFNAAibYAHH-NH2 |
| 1083 | Ac-RWIAQQLRAibIGDAibFNAAibYAHH-NH2 |
| 1084 | Ac-RCou2IAQELR$r5IGDStFNA$YAHH-NH2 |
| 1085 | Ac-RWIAQELR$r5IGDStFNA$YAHH-NH2 |
| 1086 | Ac-ICou2IAQELR$IGD$FNAYYARR-NH2 |
| 1087 | Ac-IWIAQALR4Me$5a5IGD$5n3FNAibFYAHH-NH2 |
| 1088 | Ac-IWIAQALR4Ph$5a5IGD$5n3FNAibFYAHH-NH2 |
| 1089 | Ac-NleWIAQALR$r5IGDStFNA$YAHH-NH2 |
| 1090 | Ac-KWIAQALR$r5IGDStFNA$YAHH-NH2 |
| 1091 | Ac-RWIAQALR$r5IGDStFNA$YQHH-NH2 |
| 1092 | Ac-IWIAQALR$r5IGDStFNA$YQHH-NH2 |
| 1093 | Ac-NleCou2IAQALR$r5IGDStFNA$YAHH-NH2 |
| 1094 | Ac-KCou2IAQALR$r5IGDStFNA$YAHH-NH2 |
| 1095 | Ac-IWIAQELRRIGDEF$AYY$RR-NH2 |
| 1096 | Ac-IWIAQELRRIGDEFN$YYA$R-NH2 |
| 1097 | Ac-IWIAQEL$r8RIGDEF$AYYARR-NH2 |
| 1098 | Ac-IWIAQELR$r8IGDEFN$YYARR-NH2 |
| 1099 | Ac-IWIAQELRRIGD$r8FNAYYA$R-NH2 |
| 1100 | Ac-I$IAQStLRRIGD$s8FNAYYARR-NH2 |
| 1101 | Ac-I$r8IAQELRStIGD$r5FNAYYARR-NH2 |
| 1102 | Ac-I$r8IAQELRStIGDEFN$s8YYARR-NH2 |
| 1103 | Ac-IWI$QELStRIGDEF$s8AYYARR-NH2 |
| 1104 | Ac-IWIA$ELRStIGD$r5FNAYYARR-NH2 |
| 1105 | Ac-IWIA$r5ELRStIGD$FNAYYARR-NH2 |
| 1106 | Ac-IWIA$ELRStIGDEFN$s8YYARR-NH2 |
| 1107 | Ac-IWIAQ$r8LRRIGDStFNAYYA$s8R-NH2 |
| 1108 | Ac-IWIAQEL$r8RIGDEFStAYY$r5RR-NH2 |
| 1109 | Ac-IWIAQELR$IGDStFNAYYA$s8R-NH2 |
| 1110 | Ac-IWIAQELR$r8IGDEFNStYYA$r5R-NH2 |
| 1111 | Ac-I$IAQ$LRRIGDEF$AYY$RR-NH2 |
| 1112 | Ac-I$IAQ$LRRIGDEFN$YYA$R-NH2 |
| 1113 | Ac-IWI$QEL$RIGDEF$AYY$RR-NH2 |
| 1114 | Ac-IWI$QEL$RIGDEFN$YYA$R-NH2 |
| 1115 | Ac-IWIA$ELR$IGDEF$AYY$RR-NH2 |
| 1116 | Ac-IWIA$ELR$IGDEFN$YYA$R-NH2 |
| 1117 | Ac-I$r8IAQELR$IGDEF$AYY$RR-NH2 |
| 1118 | Ac-I$r8IAQELR$IGDEFN$YYA$R-NH2 |
| 1119 | Ac-IWIAQ$r8LRRIGD$F$AYY$RR-NH2 |
| 1120 | Ac-IWIAQ$r8LRRIGD$FN$YYA$R-NH2 |
| 1121 | Ac-I$IAQ$L$r8RIGDEF$AYYARR-NH2 |
| 1122 | Ac-I$IAQ$LR$r8IGDEF$YYARR-NH2 |
| 1123 | Ac-I$IAQ$LRRIGD$r8FNAYYA$R-NH2 |
| 1124 | Ac-IWI$QEL$RIGD$r8FNAYYA$R-NH2 |
| 1125 | Ac-IWIA$ELR$IGD$r8FNAYYA$R-NH2 |
| 1126 | 5-FAM-BaIWIAQELRRIGDEFNAYYARR-NH2 |
| 1127 | 5-FAM-BaIWIAQELR$IGD$FNAYYARR-NH2 |
| 1128 | 5-FAM-BaNLWAAQRYGRELR$NleSD$FVDSFKK-NH2 |
| 1129 | 5-FAM-BaKALETLR$VGD$VQRNHETAF-NH2 |
| 1130 | Ac-RCou2IAQALR$IGD$FNAFYARR-NH2 |
| 1131 | Ac-RCou2IAQALR$5rn3IGDSta5FNA$5n3YAHH-NH2 |
| 1132 | Ac-IWI$QEL$RIGDEF$AYY$RR-NH2 |
| 1133 | Ac-IWIAQ$r8LRRIGD$F$AYY$RR-NH2 |
| 1134 | Ac-IWIAQ$r8LRRIGD$FN$YYA$R-NH2 |
| 1135 | Ac-IWI$QEL$RIGD$r8FNAYYA$R-NH2 |
| 1136 | Ac-IWIA$ELR$IGD$r8FNAYYA$R-NH2 |
| 1137 | Ac-IWI$QELStRIGDEF$s8AYYARR-NH2 |
| 1138 | Ac-IWIAQ$r8LRRIGDStFNAYYA$s8R-NH2 |
| 1139 | Ac-IWIAQEL$r8RIGDEFStAYY$r5RR-NH2 |
| 1140 | Ac-I$r8IAQELR$IGDEF$AYY$RR-NH2 |
| 1141 | Ac-IWIAQ$r8LRRIGD$FNAYYARR-NH2 |
| 1142 | Ac-IWIAQELRRIGDEF$AYY$RR-NH2 |
| 1143 | Ac-IWIAQALR$r8IGDAFN$YYA-NH2 |
| 1144 | Ac-WIAQALR$r8IGDAFN$YYA-NH2 |
| 1145 | Ac-IAQALR$r8IGDAFN$YYA-NH2 |
| 1146 | Ac-IAAALR$r8IGDAFN$YYA-NH2 |
| 1147 | Ac-IAQALA$r8IGDAFN$YYA-NH2 |
| 1148 | Ac-IAQALR$r8IADAFN$YYA-NH2 |
| 1149 | Ac-IAQALR$r8IGDAAN$YYA-NH2 |
| 1150 | Ac-IAQALR$r8IGDAFA$YYA-NH2 |
| 1151 | Ac-IAQALR$r8IGDAFN$AYA-NH2 |
| 1152 | Ac-IAQALR$r8IGDAFN$YAA-NH2 |
| 1153 | Ac-IAQALRRIGDEFNAYYAHH-NH2 |

TABLE 1-continued

| SEQ ID NO | Peptide sequence |
|---|---|
| 1154 | Ac-IAQALR$IGD$FNAYYAHH-NH2 |
| 1155 | Ac-IWIAQALRRIGDEFNAYYAHH-NH2 |
| 1156 | Ac-IWIAQALR$IGD$FNAYYAHH-NH2 |
| 1157 | Ac-I$IAQ$LR$IGD$FNAYYAHH-NH2 |
| 1158 | HepIAQ$LRRIGDEFNAYYAHH-NH2 |
| 1159 | HepIAQ$LR$IGD$FNAYYAHH-NH2 |
| 1160 | HepIA$ALRRIGDEFNAYYAHH-NH2 |
| 1161 | HepIA$ALR$IGD$FNAYYAHH-NH2 |
| 1162 | Ac-I$IAQ$LRRIGDEF$AYY$AA-NH2 |
| 1163 | Ac-I$IAQ$LRRIGDEF$AYY$A-NH2 |
| 1164 | Ac-I$IAA$LRRIGDEF$AYY$A-NH2 |
| 1165 | Ac-I$IAV$LRRIGDEF$AYY$A-NH2 |
| 1166 | Ac-I$IAL$LRRIGDEF$AYY$A-NH2 |
| 1167 | Ac-I$IAI$LRRIGDEF$AYY$A-NH2 |
| 1168 | Ac-I$IAF$LRRIGDEF$AYY$A-NH2 |
| 1169 | Ac-I$IAY$LRRIGDEF$AYY$A-NH2 |
| 1170 | Ac-I$IAG$LRRIGDEF$AYY$A-NH2 |
| 1171 | Ac-I$IAQ$LRAIGDAF$AYY$A-NH2 |
| 1172 | Ac-I$IAQ$LRAIGDAibF$AYY$A-NH2 |
| 1173 | Ac-I$IAQ$LRAibIGDAF$AYY$A-NH2 |
| 1174 | Ac-I$IAQ$LRAibIGDAibF$AYY$A-NH2 |
| 1175 | Ac-I$IAQ$LRNleIGDNleF$AYY$A-NH2 |
| 1176 | Ac-I$IAQ$LRNleIGDAibF$AYY$A-NH2 |
| 1177 | Ac-I$IAQ$LRAibIGDNleF$AYY$A-NH2 |
| 1178 | Ac-I$IAQ$LR$r8IGDEFN$YYA-NH2 |
| 1179 | Ac-I$IAA$LR$r8IGDEFN$YYA-NH2 |
| 1180 | Ac-I$IAV$LR$r8IGDEFN$YYA-NH2 |
| 1181 | Ac-I$IAL$LR$r8IGDEFN$YYA-NH2 |
| 1182 | Ac-I$IAI$LR$r8IGDEFN$YYA-NH2 |
| 1183 | Ac-I$IAF$LR$r8IGDEFN$YYA-NH2 |
| 1184 | Ac-I$IAY$LR$r8IGDEFN$YYA-NH2 |
| 1185 | Ac-I$IAG$LR$r8IGDEFN$YYA-NH2 |
| 1186 | Ac-I$IAQ$LR$r8IGDAFN$YYA-NH2 |
| 1187 | Ac-I$IAQ$LR$r8IGDNleFN$YYA-NH2 |
| 1188 | Ac-I$IAQ$LR$r8IGDAibFN$YYA-NH2 |
| 1189 | Ac-IWIA$ELR$IGD$r8FNAYYA$A-NH2 |
| 1190 | Ac-IWIA$ALR$IGD$r8FNAYYA$A-NH2 |
| 1191 | Ac-IWIA$VLR$IGD$r8FNAYYA$A-NH2 |
| 1192 | Ac-IWIA$LLR$IGD$r8FNAYYA$A-NH2 |
| 1193 | Ac-IWIA$ILR$IGD$r8FNAYYA$A-NH2 |
| 1194 | Ac-IWIA$FLR$IGD$r8FNAYYA$A-NH2 |
| 1195 | Ac-IWIA$YLR$IGD$r8FNAYYA$A-NH2 |
| 1196 | Ac-IWIA$GLR$IGD$r8FNAYYA$A-NH2 |
| 1197 | Ac-IWIA$SLR$IGD$r8FNAYYA$A-NH2 |
| 1198 | Ac-I$IAQ$LRRIGDEF$AYY$-NH2 |
| 1199 | Ac-IWIA$ELR$IGD$r8FNAYYA$-NH2 |
| 1200 | Ac-WIAQALR$r8IGDAFN$YYA-NH2 |
| 1201 | Ac-IAQALR$r8IGDAFN$YYA-NH2 |
| 1202 | Ac-IAAALR$r8IGDAFN$YYA-NH2 |
| 1203 | Ac-IAQALA$r8IGDAFN$YYA-NH2 |
| 1204 | Ac-IAQALR$r8IADAFN$YYA-NH2 |
| 1205 | Ac-IAQALR$r8IGDAAN$YYA-NH2 |
| 1206 | Ac-IAQALR$r8IGDAFA$YYA-NH2 |
| 1207 | Ac-IAQALR$r8IGDAFN$AYA-NH2 |
| 1208 | Ac-IAQALR$r8IGDAFN$YAA-NH2 |
| 1209 | Ac-I$IAL$LR$r8IGDAFN$YYA-NH2 |
| 1210 | Ac-I$IALALR$IGDAFN$YYA$A-NH2 |
| 1211 | Ac-IWIA$ALR$IGDAFN$YYA$A-NH2 |
| 1212 | Ac-IWIA$ALRStIGDAFN$s8YYA-NH2 |
| 1213 | Ac-IWIA$ALRStIGDNleFN$s8YYA-NH2 |
| 1214 | Ac-I$r8IALALRStIGDAFN$s8YYA-NH2 |
| 1215 | Ac-I$r8IALALRStIGD$r5FNAYYA-NH2 |
| 1216 | Ac-IWIALALR$IGD$FNAYYA-NH2 |
| 1217 | Ac-IWIAQALR$IGD$FNAYYA-NH2 |
| 1218 | Ac-I$IAA$LRAibIGDAibF$AYY$A-NH2 |
| 1219 | Ac-I$IAL$LRAibIGDAibF$AYY$A-NH2 |
| 1220 | Ac-I$r8IALALR$IGDAF$AYY$A-NH2 |
| 1221 | Ac-I$r8IAQELRStIGDAFN$s8YYARR-NH2 |
| 1222 | Ac-I$r8IAQALRStIGDAFN$s8YYA-NH2 |
| 1223 | HBS-IAAarALRRIGDEFNAYYAHH-NH2 |
| 1224 | HBS-IAAarALR$IGD$FNAYYAHH-NH2 |
| 1225 | HBS-IWAarAQALRRIGDEFNAYYAHH-NH2 |
| 1226 | HBS-IWAarAQALR$IGD$FNAYYAHH-NH2 |
| 1227 | HepIAQ$LRRIGDEFNAYYAHH-NH2 |
| 1228 | HepIAQ$LR$IGD$FNAYYAHH-NH2 |
| 1229 | HepIA$ALR$IGD$FNAYYAHH-NH2 |

TABLE 1-continued

| SEQ ID NO | Peptide sequence |
|---|---|
| 1230 | Ac-I$IAQ$LR$r8IGDEFN$YYA-NH2 |
| 1231 | Ac-I$IAA$LR$r8IGDEFN$YYA-NH2 |
| 1232 | Ac-I$IAV$LR$r8IGDEFN$YYA-NH2 |
| 1233 | Ac-I$IAV$LR$r8IGDEFN$YYA-NH2 |
| 1234 | Ac-I$IAI$LR$r8IGDEFN$YYA-NH2 |
| 1235 | Ac-I$IAI$LR$r8IGDEFN$YYA-NH2 |
| 1236 | Ac-I$IAY$LR$r8IGDEFN$YYA-NH2 |
| 1237 | Ac-I$IAL$LR$r8IGDEFN$YYA-NH2 |
| 1238 | Ac-I$IAL$LR$r8IGDEFN$YYA-NH2 |
| 1239 | Ac-I$IAF$LR$r8IGDEFN$YYA-NH2 |
| 1240 | Ac-I$IAF$LR$r8IGDEFN$YYA-NH2 |
| 1241 | Ac-I$IAQ$LR$r8IGDAFN$YYA-NH2 |
| 1242 | Ac-I$IAQ$LR$r8IGDNleFN$YYA-NH2 |
| 1243 | Ac-I$IAQ$LR$r8IGDAibFN$YYA-NH2 |
| 1244 | Ac-I$IAQ$LRRIGDEF$AYY$-NH2 |
| 1245 | Ac-I$IAA$LRRIGDEF$AYY$-NH2 |
| 1246 | Ac-I$IAV$LRRIGDEF$AYY$-NH2 |
| 1247 | Ac-I$IAL$LRRIGDEF$AYY$-NH2 |
| 1248 | Ac-I$IAI$LRRIGDEF$AYY$-NH2 |
| 1249 | Ac-I$IAF$LRRIGDEF$AYY$-NH2 |
| 1250 | Ac-I$IAY$LRRIGDEF$AYY$-NH2 |
| 1251 | Ac-I$IAG$LRRIGDEF$AYY$-NH2 |
| 1252 | Ac-I$IAQ$LRAIGDAF$AYY$-NH2 |
| 1253 | Ac-I$IAQ$LRAIGDAibF$AYY$-NH2 |
| 1254 | Ac-I$IAQ$LRAibIGDAF$AYY$-NH2 |
| 1255 | Ac-I$IAQ$LRAibIGDAibF$AYY$-NH2 |
| 1256 | Ac-I$IAQ$LRNleIGDNleF$AYY$-NH2 |
| 1257 | Ac-I$IAQ$LRNleIGDAibF$AYY$-NH2 |
| 1258 | Ac-I$IAQ$LRAibIGDNleF$AYY$-NH2 |
| 1259 | Ac-IWIA$ALR$IGD$r8FNAYYA$-NH2 |
| 1260 | Ac-IWIA$VLR$IGD$r8FNAYYA$-NH2 |
| 1261 | Ac-IWIA$LLR$IGD$r8FNAYYA$-NH2 |
| 1262 | Ac-IWIA$ILR$IGD$r8FNAYYA$-NH2 |
| 1263 | Ac-IWIA$FLR$IGD$r8FNAYYA$-NH2 |
| 1264 | Ac-IWIA$YLR$IGD$r8FNAYYA$-NH2 |
| 1265 | Ac-IWIA$GLR$IGD$r8FNAYYA$-NH2 |
| 1266 | Ac-IWIA$SLR$IGD$r8FNAYYA$-NH2 |
| 1267 | Ac-I$r8IALALR$IGDAFN$YYA$A-NH2 |
| 1268 | Ac-IWIA$r5ALRStIGDNleFN$r8YYA-NH2 |
| 1269 | Ac-I$IAL$LR$r8IGDAFN$YYA-NH2 |
| 1270 | Ac-ICou2IAQALR$r5IGDStFNA$YAHH-NH2 |
| 1271 | Ac-I$IAQ$LRAIGDAF$AYY$-NH2 |
| 1272 | Ac-I$IAQ$LRAIGDAibF$AYY$-NH2 |
| 1273 | Ac-I$IAQ$LRAIGDAibF$AYY$-NH2 |
| 1274 | Ac-I$IAQ$LRAibIGDAF$AYY$-NH2 |
| 1275 | Ac-I$IAQ$LRAibIGDAF$AYY$-NH2 |
| 1276 | Ac-I$IAQ$LRAibIGDAibF$AYY$-NH2 |
| 1277 | Ac-I$IAQ$LRAibIGDAibF$AYY$-NH2 |
| 1278 | Ac-I$IAQ$LRNleIGDNleF$AYY$-NH2 |
| 1279 | Ac-I$IAQ$LRNleIGDNleF$AYY$-NH2 |
| 1280 | Ac-I$IAQ$LRNleIGDAibF$AYY$-NH2 |
| 1281 | Ac-I$IAQ$LRNleIGDAibF$AYY$-NH2 |
| 1282 | Ac-IWIA$VLR$IGD$r8FNAYYA$-NH2 |
| 1283 | Ac-IWIA$LLR$IGD$r8FNAYYA$-NH2 |
| 1284 | Ac-IWIA$FLR$IGD$r8FNAYYA$-NH2 |
| 1285 | Ac-IWIA$SLR$IGD$r8FNAYYA$-NH2 |
| 1286 | Ac-IWIA$ELR$IGD$r8FNAYYA$-NH2 |
| 1287 | Ac-IWIA$ALR$IGD$r8FNAYYA$-NH2 |
| 1288 | Ac-I$IAA$LRRIGDEF$AYY$-NH2 |
| 1289 | Ac-I$IAA$LRRIGDEF$AYY$-NH2 |
| 1290 | Ac-I$IAL$LRRIGDEF$AYY$RR-NH2 |
| 1291 | Ac-I$IAQ$LRAibIGDAF$AYY$RR-NH2 |
| 1292 | Ac-I$IAL$LRAibIGDAF$AYY$RR-NH2 |
| 1293 | Ac-I$IAL$LRRIGDEF$AYY$R-NH2 |
| 1294 | Ac-I$IAQ$LRAibIGDAF$AYY$R-NH2 |
| 1295 | Ac-I$IAL$LRAibIGDAF$AYY$R-NH2 |
| 1296 | Ac-I$IAY$LR$r8IGDEFN$YYARR-NH2 |
| 1297 | Ac-I$IAL$LR$r8IGDEFN$YYARR-NH2 |
| 1298 | Ac-I$IAF$LR$r8IGDEFN$YYARR-NH2 |
| 1299 | Ac-I$IAQ$LR$r8IGDEFN$YYAR-NH2 |
| 1300 | Ac-I$IAY$LR$r8IGDEFN$YYAR-NH2 |
| 1301 | Ac-I$IAL$LR$r8IGDEFN$YYAR-NH2 |
| 1302 | Ac-I$IAF$LR$r8IGDEFN$YYAR-NH2 |
| 1303 | Ac-IWIA$ALR$IGD$r8FNAYYA$R-NH2 |
| 1304 | Ac-IWIALALR$r8IGDEFN$YYARR-NH2 |
| 1305 | Ac-IWIAYALR$r8IGDEFN$YYARR-NH2 |

TABLE 1-continued

| SEQ ID NO | Peptide sequence |
|---|---|
| 1306 | Ac-IWIAQALR$r8IGDEFN$YYAR-NH2 |
| 1307 | Ac-IWIALALR$r8IGDEFN$YYAR-NH2 |
| 1308 | Ac-IWIAYALR$r8IGDEFN$YYAR-NH2 |
| 1309 | Ac-IWIALALR$IGD$FNAYYARR-NH2 |
| 1310 | Ac-IWIAYALR$IGD$FNAYYARR-NH2 |
| 1311 | Ac-IWIALALR$IGD$FNAYYAR-NH2 |
| 1312 | Ac-IWIAYALR$IGD$FNAYYAR-NH2 |
| 1313 | Ac-IWIALALR$IGD$FNAYYAH-NH2 |
| 1314 | Ac-IWIAQALR%r8IGDAFN%YYA-NH2 |
| 1315 | Ac-I$IAL$LRRIGDEF$AYY$RR-NH2 |
| 1316 | Ac-I$IAL$LRRIGDEF$AYY$R-NH2 |
| 1317 | Ac-I$IAQ$LRAibIGDAF$AYY$R-NH2 |
| 1318 | Ac-I$IAL$LRAibIGDAF$AYY$R-NH2 |
| 1319 | Ac-I$IAY$LR$r8IGDEFN$YYARR-NH2 |
| 1320 | Ac-I$IAL$LR$r8IGDEFN$YYARR-NH2 |
| 1321 | Ac-IWIA$ALR$IGD$r8FNAYYA$R-NH2 |
| 1322 | Ac-I$IAY$LR$r8IGDEFN$YYAR-NH2 |
| 1323 | Ac-I$IAL$LR$r8IGDEFN$YYAR-NH2 |
| 1324 | Ac-I$IAF$LR$r8IGDEFN$YYAR-NH2 |
| 1325 | Ac-I$IAQ$LR$r8IGDAFN$YYARR-NH2 |
| 1326 | Ac-I$IAY$LR$r8IGDAFN$YYARR-NH2 |
| 1327 | Ac-I$IAL$LR$r8IGDAFN$YYARR-NH2 |
| 1328 | Ac-I$IAF$LR$r8IGDAFN$YYARR-NH2 |
| 1329 | Ac-I$IAQ$LR$r8IGDAFN$YYAR-NH2 |
| 1330 | Ac-I$IAY$LR$r8IGDAFN$YYAR-NH2 |
| 1331 | Ac-I$IAL$LR$r8IGDAFN$YYAR-NH2 |
| 1332 | Ac-I$IAF$LR$r8IGDAFN$YYAR-NH2 |
| 1333 | Ac-IWIAQALR$r8IGDEFN$YYA-NH2 |
| 1334 | Ac-IWIAQALR$r8IGDQFN$YYA-NH2 |
| 1335 | Ac-I?W?I?A?A?A?L?R?$r8?IGDEFN$YYA-NH2 |
| 1336 | Ac-I?W?I?A?A?A?L?R?$r8?IGDQFN$YYA-NH2 |
| 1337 | Ac-I?W?I?A?A?A?L?R?$r8?IGDAFN$YYA-NH2 |
| 1338 | Ac-IWIAQALR$r8IGDEFA$YYA-NH2 |
| 1339 | Ac-IWIAQALR$r8IGDQFA$YYA-NH2 |
| 1340 | Ac-IWIAQALR$r8IGDAFA$YYA-NH2 |
| 1341 | Ac-IWIAQALCit$r8IGDAFN$YYA-NH2 |
| 1342 | Ac-IWIAQALCit$r8IGDQFN$YYA-NH2 |
| 1343 | Ac-IWIAQALH$r8IGDAFN$YYA-NH2 |
| 1344 | Ac-IWIAQALH$r8IGDQFN$YYA-NH2 |
| 1345 | Ac-IWIAQALQ$r8IGDAFN$YYA-NH2 |
| 1346 | Ac-IWIAQALQ$r8IGDQFN$YYA-NH2 |
| 1347 | Ac-IWIAQALR$r8IGDAAN$YYA-NH2 |
| 1348 | Ac-IWIAQALR$r8IGDQAN$YYA-NH2 |
| 1349 | Ac-IWIAQALR$r8IGDAIN$YYA-NH2 |
| 1350 | Ac-IWIAQALR$r8IGDQIN$YYA-NH2 |
| 1351 | Ac-IWIAQAAR$r8IGDAAN$YYA-NH2 |
| 1352 | Ac-IWIAQALR$r8IADAFN$YYA-NH2 |
| 1353 | Ac-IWIAQALR$r8IADQFN$YYA-NH2 |
| 1354 | Ac-IWIAQALR$r8AGDAFN$YYA-NH2 |
| 1355 | Ac-IWIAQALR$r8AGDQFN$YYA-NH2 |
| 1356 | Ac-IWIAQALR$r8FGDAFN$YYA-NH2 |
| 1357 | Ac-IWIAQALR$r8FGDQFN$YYA-NH2 |
| 1358 | Ac-IWFAQALR$r8IGDAFN$YYA-NH2 |
| 1359 | Ac-IWFAQALR$r8IGDQFN$YYA-NH2 |
| 1360 | Ac-IAIAQALR$r8IGDAFN$YYA-NH2 |
| 1361 | Ac-IWIAQALA$r8IGDAFN$YYA-NH2 |
| 1362 | Ac-IWIAQALR$r8IGNAFN$YYA-NH2 |
| 1363 | Ac-IWIAQAAR$r8IGDAFN$YYA-NH2 |
| 1364 | FITC-BaIWIAQALR$r8IGDAFN$YYA-NH2 |
| 1365 | 5-FAM-BaIWIAQALR$r8IGDAFN$YYA-NH2 |
| 1366 | 5-FAM-BaIWIAQALR$r8IGDEFN$YYA-NH2 |
| 1367 | Ac-WLAQLLR$IGD$IN-NH2 |
| 1368 | Ac-ICou2IALALR$IGD$FNAYYA-NH2 |
| 1369 | Ac-ICou2IALALR$IGD$FNAibFYA-NH2 |
| 1370 | Ac-I$IAY$LR$r8IGDAFN$YYARR-NH2 |
| 1371 | Ac-I$IAL$LR$r8IGDAFN$YYARR-NH2 |
| 1372 | Ac-I$IAF$LR$r8IGDAFN$YYARR-NH2 |
| 1373 | Ac-I$IAQ$LR$r8IGDAFN$YYAR-NH2 |
| 1374 | Ac-I$IAY$LR$r8IGDAFN$YYAR-NH2 |
| 1375 | Ac-I$IAL$LR$r8IGDAFN$YYAR-NH2 |
| 1376 | Ac-I$IAF$LR$r8IGDAFN$YYAR-NH2 |
| 1377 | Ac-IAIAQALR$r8IGDAFN$YYA-NH2 |
| 1378 | Ac-IWIAQALR$r8IGDEFN$YYA-NH2 |
| 1379 | Ac-IWIAQALR$r8IGDQFN$YYA-NH2 |
| 1380 | Ac-I?W?I?A?A?A?L?R?$r8?IGDEFN$YYA-NH2 |
| 1381 | Ac-I?W?I?A?A?A?L?R?$r8?IGDQFN$YYA-NH2 |

TABLE 1-continued

| SEQ ID NO | Peptide sequence |
|---|---|
| 1382 | Ac-I?W?I?A?A?A?L?R?$r8?IGDAFN$YYA-NH2 |
| 1383 | Ac-IWIAQALR$r8IGDAFA$YYA-NH2 |
| 1384 | Ac-IWIAQALCit$r8IGDAFN$YYA-NH2 |
| 1385 | Ac-IWIAQALCit$r8IGDQFN$YYA-NH2 |
| 1386 | Ac-IWIAQALH$r8IGDAFN$YYA-NH2 |
| 1387 | Ac-IWIAQALH$r8IGDQFN$YYA-NH2 |
| 1388 | Ac-IWIAQALQ$r8IGDAFN$YYA-NH2 |
| 1389 | Ac-IWIAQALQ$r8IGDQFN$YYA-NH2 |
| 1390 | Ac-IWIAQALR$r8IGDAAN$YYA-NH2 |
| 1391 | Ac-IWIAQALR$r8IGDAIN$YYA-NH2 |
| 1392 | Ac-IWIAQALR$r8IGDQIN$YYA-NH2 |
| 1393 | Ac-IWIAQAAR$r8IGDAAN$YYA-NH2 |
| 1394 | Ac-IWIAQALR$r8IADAFN$YYA-NH2 |
| 1395 | Ac-IWIAQALR$r8IADQFN$YYA-NH2 |
| 1396 | Ac-IWIAQALR$r8AGDAFN$YYA-NH2 |
| 1397 | Ac-IWIAQALR$r8AGDQFN$YYA-NH2 |
| 1398 | Ac-IWIAQALR$r8FGDAFN$YYA-NH2 |
| 1399 | Ac-IWIAQALR$r8FGDQFN$YYA-NH2 |
| 1400 | Ac-IWFAQALR$r8IGDAFN$YYA-NH2 |
| 1401 | Ac-IWFAQALR$r8IGDQFN$YYA-NH2 |
| 1402 | Ac-IWIAQALA$r8IGDAFN$YYA-NH2 |
| 1403 | Ac-IWIAQALR$r8IGNAFN$YYA-NH2 |
| 1404 | Ac-IWIAQAAR$r8IGDAFN$YYA-NH2 |
| 1405 | Ac-IWIALALG$IGD$VNAYYA-NH2 |
| 1406 | Ac-IWIALALG$IGD$INAYYA-NH2 |
| 1407 | Ac-IWIALALG$IGN$VNAYYA-NH2 |
| 1408 | Ac-IWIALALG$IGN$INAYYA-NH2 |
| 1409 | Ac-IWIALALN$IGD$VNAYYA-NH2 |
| 1410 | Ac-IWIALALN$IGD$INAYYA-NH2 |
| 1411 | Ac-IWIALALN$IGN$VNAYYA-NH2 |
| 1412 | Ac-IWIALALN$IGN$INAYYA-NH2 |
| 1413 | Ac-IWIALALR$IGD$VNAFYA-NH2 |
| 1414 | Ac-IWIALALR$IGD$VNAYYA-NH2 |
| 1415 | Ac-IWIALALR$IGD$VNAibFYA-NH2 |
| 1416 | Ac-IWIALALR$IGD$VNAibYYA-NH2 |
| 1417 | Ac-IWFALALR$IGD$FNAYYA-NH2 |
| 1418 | Ac-IWYALALR$IGD$FNAYYA-NH2 |
| 1419 | Ac-IWVALALR$IGD$FNAYYA-NH2 |
| 1420 | Ac-IWLALALR$IGD$FNAYYA-NH2 |
| 1421 | Ac-IWIAQALR$IGD$VNAYYA-NH2 |
| 1422 | Ac-IWIAQALR$IGD$INAYYA-NH2 |
| 1423 | Ac-IWIALALR$IGD$INAYYA-NH2 |
| 1424 | Ac-IWIALLLR$IGD$VNAYYA-NH2 |
| 1425 | Ac-IWIALLLR$IGD$INAYYA-NH2 |
| 1426 | Ac-IWIALALG$IGD$FNAYYA-NH2 |
| 1427 | Ac-IWIALALS$IGD$FNAYYA-NH2 |
| 1428 | Ac-IWIALALH$IGD$FNAYYA-NH2 |
| 1429 | Ac-IWIALALN$IGD$FNAYYA-NH2 |
| 1430 | Ac-IWIALAIG$IGD$VNAYYA-NH2 |
| 1431 | Ac-IWIALAIG$IGD$INAYYA-NH2 |
| 1432 | Ac-IWIALAIN$IGD$VNAYYA-NH2 |
| 1433 | Ac-IWIALAIN$IGD$INAYYA-NH2 |
| 1434 | Ac-IWIALALN$IGD$VNAYYAHH-NH2 |
| 1435 | Ac-IWIALALN$IGD$INAYYAHH-NH2 |
| 1436 | Ac-IWIALALN$IGN$VNAYYAHH-NH2 |
| 1437 | Ac-IWIALALN$IGN$INAYYAHH-NH2 |
| 1438 | Ac-IWIA$r5ALGStIGD$VNAYYA-NH2 |
| 1439 | Ac-IWIA$r5ALGStIGD$INAYYA-NH2 |
| 1440 | Ac-IWIA$r5ALGStIGN$VNAYYA-NH2 |
| 1441 | Ac-IWIA$r5ALGStIGN$INAYYA-NH2 |
| 1442 | Ac-IWIALALR$IGD$VNAAAA-NH2 |
| 1443 | Ac-IWIALALG$IGD$VNAAAA-NH2 |
| 1444 | Ac-IWIALALD$IGD$VNAAAA-NH2 |
| 1445 | Ac-IWIALALN$IGD$VNAAAA-NH2 |
| 1446 | Ac-IWIALALR$IGD$VN-NH2 |
| 1447 | Ac-IWIALALG$IGD$VN-NH2 |
| 1448 | Ac-IWIALALD$IGD$VN-NH2 |
| 1449 | Ac-IWIALALN$IGD$VN-NH2 |
| 1450 | 5-FAM-BaIWIA$r5ALGStIGD$VNAYYA-NH2 |
| 1451 | 5-FAM-BaIWIALALR$IGD$FNAibFYA-NH2 |
| 1452 | 5-FAM-BaIWIA$r5ALGStIGN$INAYYA-NH2 |
| 1453 | 5-FAM-BaIWIALALG$IGN$INAYYA-NH2 |
| 1454 | FITC-BaIWIA$r5ALGStIGD$VNAYYA-NH2 |
| 1455 | FITC-BaIWIALALR$IGD$FNAibFYA-NH2 |
| 1456 | 5-FAM-BaIWIA$r5ALGStIGD$INAYYA-NH2 |
| 1457 | Ac-IWIAQALR$r8IGDQFA$YYA-NH2 |

TABLE 1-continued

| SEQ ID NO | Peptide sequence |
|---|---|
| 1458 | Ac-RWIAQALR$IGD$LNAFYAHH-NH2 |
| 1459 | Ac-RWIAQELR$IGD$LNAibFYAHH-NH2 |
| 1460 | Ac-RWIAQALR$IGD$LNAibFYA-NH2 |
| 1461 | Ac-RWIAQAAR$IGD$LNAibFYAHH-NH2 |
| 1462 | Ac-RWIAQALA$IGD$LNAibFYAHH-NH2 |
| 1463 | Ac-RW1AQALR$IGN$LNAibFYAHH-NH2 |
| 1464 | Ac-RWIAQALCit$IGD$LNAibFYAHH-NH2 |
| 1465 | Ac-RWIAQALR$IGD$ANAibFYAHH-NH2 |
| 1466 | Ac-RCou2IAQAAR$IGD$LNAibFYAHH-NH2 |
| 1467 | Ac-RCou2IAQALA$IGD$LNAibFYAHH-NH2 |
| 1468 | Ac-RCou2IAQALR$IGN$LNAibFYAHH-NH2 |
| 1469 | Ac-RCou2IAQALCit$IGD$LNAibFYAHH-NH2 |
| 1470 | Ac-IWIAMOALCit$r8IGDAFN$YYA-NH2 |
| 1471 | Ac-IWIAMO2ALCit$r8IGDAFN$YYA-NH2 |
| 1472 | Ac-RWIAMOALR$IGD$LNAibFYAHH-NH2 |
| 1473 | Ac-RWIAMO2ALR$IGD$LNAibFYAHH-NH2 |
| 1474 | Ac-RWIAQALR$IGN$VNAibFYAHH-NH2 |
| 1475 | Ac-RWIAQAAR$IGD$VNAibFYAHH-NH2 |
| 1476 | Ac-RWIAQALA$IGD$VNAibFYAHH-NH2 |
| 1477 | Ac-RWIAQALCit$IGD$VNAibFYAHH-NH2 |
| 1478 | Ac-RCou2IAQALR$IGD$VNAibFYAHH-NH2 |
| 1479 | Ac-RCou2IAQALR$IGN$VNAibFYAHH-NH2 |
| 1480 | Ac-RCou2IAQAAR$IGD$VNAibFYAHH-NH2 |
| 1481 | Ac-RCou2IAQALA$IGD$VNAibFYAHH-NH2 |
| 1482 | Ac-RCou2IAQALCit$IGD$VNAibFYAHH-NH2 |
| 1483 | Ac-IWChaAQALR$r8IGDAFN$YYA-NH2 |
| 1484 | Ac-IWhhLAQALR$r8IGDAFN$YYA-NH2 |
| 1485 | Ac-IWAdmAQALR$r8IGDAFN$YYA-NH2 |
| 1486 | Ac-IWhChaAQALR$r8IGDAFN$YYA-NH2 |
| 1487 | Ac-IWhFAQALR$r8IGDAFN$YYA-NH2 |
| 1488 | Ac-IWIg1AQALR$r8IGDAFN$YYA-NH2 |
| 1489 | Ac-IWF4CF3AQALR$r8IGDAFN$YYA-NH2 |
| 1490 | Ac-IWF4tBuAQALR$r8IGDAFN$YYA-NH2 |
| 1491 | Ac-IW2NalAQALR$r8IGDAFN$YYA-NH2 |
| 1492 | Ac-IWBipAQALR$r8IGDAFN$YYA-NH2 |
| 1493 | Ac-IWIAQAChaR$r8IGDAFN$YYA-NH2 |
| 1494 | Ac-IWIAQAhhLR$r8IGDAFN$YYA-NH2 |
| 1495 | Ac-IWIAQAAdmR$r8IGDAFN$YYA-NH2 |
| 1496 | Ac-IWIAQAhChaR$r8IGDAFN$YYA-NH2 |
| 1497 | Ac-IWIAQAhAdmR$r8IGDAFN$YYA-NH2 |
| 1498 | Ac-IWIAQAhFR$r8IGDAFN$YYA-NH2 |
| 1499 | Ac-IWIAQAIglR$r8IGDAFN$YYA-NH2 |
| 1500 | Ac-IWIAQAF4CF3R$r8IGDAFN$YYA-NH2 |
| 1501 | Ac-IWIAQAF4tBuR$r8IGDAFN$YYA-NH2 |
| 1502 | Ac-IWIAQA2NalR$r8IGDAFN$YYA-NH2 |
| 1503 | Ac-IWIAQABipR$r8IGDAFN$YYA-NH2 |
| 1504 | Ac-IWIAQALR$r8CbaGDAFN$YYA-NH2 |
| 1505 | Ac-IWIAQALR$r8hLGDAFN$YYA-NH2 |
| 1506 | Ac-IWIAQALR$r8ChaGDAFN$YYA-NH2 |
| 1507 | Ac-IWIAQALR$r8TbaGDAFN$YYA-NH2 |
| 1508 | Ac-IWIAQALR$r8hhLGDAFN$YYA-NH2 |
| 1509 | Ac-IAmWIAQALR$r8IGDAFN$YYA-NH2 |
| 1510 | Ac-IAibIAQALR$r8IGDAFN$YYA-NH2 |
| 1511 | Ac-AmLWIAQALR$r8IGDAFN$YYA-NH2 |
| 1512 | Ac-IWAmLAQALR$r8IGDAFN$YYA-NH2 |
| 1513 | Ac-IWIAibQALR$r8IGAmDAFN$YYA-NH2 |
| 1514 | Ac-IWIAAibALR$r8IGDAFN$YYA-NH2 |
| 1515 | Ac-IWIAQAAmLR$r8IGDAFN$YYA-NH2 |
| 1516 | Ac-IWIAQALR$r8IGAmDAFN$YYA-NH2 |
| 1517 | Ac-IWIAQALR$r8IGDAFN$F4FYA-NH2 |
| 1518 | Ac-IWIAQALR$r8IGDAFN$AYA-NH2 |
| 1519 | Ac-IWIAQALR$r8IGDAFN$YF4FA-NH2 |
| 1520 | Ac-IWIAQALR$r8IGDAFN$YYAib-NH2 |
| 1521 | Ac-I$r8IAQALRStIGDEFN$s8YYA-NH2 |
| 1522 | Ac-IWIA$ALRStIGDEFN$s8YYA-NH2 |
| 1523 | Ac-IWIAQALR$r8IGDEFNStYYA$r5A-NH2 |
| 1524 | Ac-IWIAQAACit$r8IGDAFN$YYA-NH2 |
| 1525 | Ac-IWIAQALCit$r8IGNAFN$YYA-NH2 |
| 1526 | Ac-IWIAQALCit$r8IGDAAN$YYA-NH2 |
| 1527 | Ac-IWIAQALCit$r8IGDAVN$YYA-NH2 |
| 1528 | Ac-RWIAQAChaR$IGD$LNAibFYAHH-NH2 |
| 1529 | Ac-RWIAQAhhLR$IGD$LNAibFYAHH-NH2 |
| 1530 | Ac-RWIAQAAdmR$IGD$LNAibFYAHH-NH2 |
| 1531 | Ac-RWIAQAhChaR$IGD$LNAibFYAHH-NH2 |
| 1532 | Ac-RWIAQAhFR$IGD$LNAibFYAHH-NH2 |
| 1533 | Ac-RWIAQAIglR$IGD$LNAibFYAHH-NH2 |

TABLE 1-continued

| SEQ ID NO | Peptide sequence |
|---|---|
| 1534 | Ac-RWIAQAF4CF3R$IGD$LNAibFYAHH-NH2 |
| 1535 | Ac-RWIAQAF4tBuR$IGD$LNAibFYAHH-NH2 |
| 1536 | Ac-RWIAQA2Na1R$IGD$LNAibFYAHH-NH2 |
| 1537 | Ac-RWIAQABipR$IGD$LNAibFYAHH-NH2 |
| 1538 | Ac-IWIAQ$r8LRRIGD$FNAYYA-NH2 |
| 1539 | Ac-IWIAQ$r8LRAIGD$FNAYYA-NH2 |
| 1540 | Ac-IWIAQ$r8LCitRIGD$FNAYYA-NH2 |
| 1541 | Ac-IWIAQ$r8LCitAIGD$FNAYYA-NH2 |
| 1542 | Ac-IWIAMOALCit$r8IGDAFN$YYA-NH2 |
| 1543 | Ac-IWIAMO2ALCit$r8IGDAFN$YYA-NH2 |
| 1544 | Ac-IWIAQALD$r8IGRAFN$YYA-NH2 |
| 1545 | Ac-RWIAQALD$IGR$LNAibFYAHH-NH2 |
| 1546 | Ac-RPEIWIAQAID$r8IGDAVN$YYAR-NH2 |
| 1547 | Ac-RPEIWIAQAID$IGD$VNAYYAR-NH2 |
| 1548 | Ac-DWIAQALR$r8IGDAFN$YYR-NH2 |
| 1549 | Ac-IWAAQALR$r8IGDAFN$YYA-NH2 |
| 1550 | Ac-IWTbaAQALR$r8IGDAFN$YYA-NH2 |
| 1551 | Ac-IWhLAQALR$r8IGDAFN$YYA-NH2 |
| 1552 | Ac-IWChgAQALR$r8IGDAFN$YYA-NH2 |
| 1553 | Ac-IWAc6cAQALR$r8IGDAFN$YYA-NH2 |
| 1554 | Ac-IWAc5cAQALR$r8IGDAFN$YYA-NH2 |
| 1555 | Ac-EWIAAALR$r8IGDAFN$YYA-NH2 |
| 1556 | Ac-RWIAAALR$r8IGDAFN$YYA-NH2 |
| 1557 | Ac-KWIAAALR$r8IGDAFN$YYA-NH2 |
| 1558 | Ac-HWIAAALR$r8IGDAFN$YYA-NH2 |
| 1559 | Ac-SWIAAALR$r8IGDAFN$YYA-NH2 |
| 1560 | Ac-QWIAAALR$r8IGDAFN$YYA-NH2 |
| 1561 | Ac-AWIAAALR$r8IGDAFN$YYA-NH2 |
| 1562 | Ac-AibWIAAALR$r8IGDAFN$YYA-NH2 |
| 1563 | Ac-FWIAAALR$r8IGDAFN$YYA-NH2 |
| 1564 | Ac-IDIAAALR$r8IGDAFN$YYA-NH2 |
| 1565 | Ac-IRIAAALR$r8IGDAFN$YYA-NH2 |
| 1566 | Ac-IHIAAALR$r8IGDAFN$YYA-NH2 |
| 1567 | Ac-ISIAAALR$r8IGDAFN$YYA-NH2 |
| 1568 | Ac-INIAAALR$r8IGDAFN$YYA-NH2 |
| 1569 | Ac-ILIAAALR$r8IGDAFN$YYA-NH2 |
| 1570 | Ac-IFIAAALR$r8IGDAFN$YYA-NH2 |
| 1571 | Ac-I2NalIAAALR$r8IGDAFN$YYA-NH2 |

TABLE 1-continued

| SEQ ID NO | Peptide sequence |
|---|---|
| 1572 | Ac-IWISAALR$r8IGDAFN$YYA-NH2 |
| 1573 | Ac-IWILAALR$r8IGDAFN$YYA-NH2 |
| 1574 | Ac-IWIFAALR$r8IGDAFN$YYA-NH2 |
| 1575 | Ac-IWIALALR$r8IGDAFN$YYA-NH2 |
| 1576 | Ac-IWIAAALF4g$r8IGDAFN$YYA-NH2 |
| 1577 | Ac-IWIAAALK$r8IGDAFN$YYA-NH2 |
| 1578 | Ac-I?W?I?A?A?A?L?R?$r8?IAbuDAFN$YYA-NH2 |
| 1579 | Ac-I?W?I?A?A?A?L?R?$r8?IVDAFN$YYA-NH2 |
| 1580 | Ac-I?W?I?A?A?A?L?R?$r8?IGEAFN$YYA-NH2 |
| 1581 | Ac-I?W?I?A?A?A?L?R?$r8?IGDAGN$YYA-NH2 |
| 1582 | Ac-IWIAQALR$r8IGDAWN$YYA-NH2 |
| 1583 | Ac-IWIAQALR$r8IGDAhFN$YYA-NH2 |
| 1584 | Ac-IWIAQALR$r8IGDAF4CF3N$YYA-NH2 |
| 1585 | Ac-IWIAQALR$r8IGDAF4tBuN$YYA-NH2 |
| 1586 | Ac-IWIAQALR$r8IGDA2NalN$YYA-NH2 |
| 1587 | Ac-IWIAQALR$r8IGDABipN$YYA-NH2 |
| 1588 | Ac-I?W?I?A?A?A?L?R?$r8?IGDAFD$YYA-NH2 |
| 1589 | Ac-I?W?I?A?A?A?L?R?$r8?IGDAFE$YYA-NH2 |
| 1590 | Ac-I?W?I?A?A?A?L?R?$r8?IGDAFQ$YYA-NH2 |
| 1591 | Ac-I?W?I?A?A?A?L?R?$r8?IGDAFS$YYA-NH2 |
| 1592 | Ac-I?W?I?A?A?A?L?R?$r8?IGDAFH$YYA-NH2 |
| 1593 | Ac-I?W?I?A?A?A?L?R?$r8?IGDAFN$LYA-NH2 |
| 1594 | Ac-IWIAQALR$r8IGDAFN$YAA-NH2 |
| 1595 | Ac-IWIAQALR$r8IGDAFN$YLA-NH2 |
| 1596 | Ac-IWIAQALR$r8IGDAFN$YChaA-NH2 |
| 1597 | Ac-IWIAQALR$r8IGDAFN$YhFA-NH2 |
| 1598 | Ac-IWIAQALR$r8IGDAFN$YWA-NH2 |
| 1599 | Ac-IWIAQALR$r8IGDAFN$Y2NalA-NH2 |
| 1600 | Ac-I?W?I?A?A?A?L?R?$r8?IGDAFN$YYD-NH2 |
| 1601 | Ac-I?W?I?A?A?A?L?R?$r8?IGDAFN$YYE-NH2 |
| 1602 | Ac-I?W?I?A?A?A?L?R?$r8?IGDAFN$YYQ-NH2 |
| 1603 | Ac-I?W?I?A?A?A?L?R?$r8?IGDAFN$YYS-NH2 |
| 1604 | Ac-I?W?I?A?A?A?L?R?$r8?IGDAFN$YYH-NH2 |
| 1605 | Ac-I?W?I?A?A?A?L?R?$r8?IGDAFN$YYR-NH2 |
| 1606 | Ac-I?W?I?A?A?A?L?R?$r8?IGDAFN$YYK-NH2 |
| 1607 | Ac-IWIAQALR$rda6IGDAFN$da5YYA-NH2 |
| 1608 | Ac-IWIAQAAmLR$r8IGDAFN$YYA-NH2 |
| 1609 | Ac-IWIAQALR$r8IGAmDAFN$YYA-NH2 |

TABLE 1-continued

| SEQ ID NO | Peptide sequence |
|---|---|
| 1610 | Ac-IWIAQALR$r8IGDAFN$F4FYA-NH2 |
| 1611 | Ac-IWIAQALR$r8IGDAFN$YYAib-NH2 |
| 1612 | Ac-IWIAQAACit$r8IGDAFN$YYA-NH2 |
| 1613 | Ac-IWIAQALCit$r8IGNAFN$YYA-NH2 |
| 1614 | Ac-IWIAQALCit$r8IGDAAN$YYA-NH2 |
| 1615 | Ac-IWIAQALCit$r8IGDAVN$YYA-NH2 |
| 1616 | Ac-IWIAQ$r8LRAIGD$FNAYYA-NH2 |
| 1617 | Ac-IWIAQ$r8LCitAIGD$FNAYYA-NH2 |
| 1618 | Ac-IWIAQALR$r8IGDAFN$AYA-NH2 |
| 1619 | Ac-IWIAQ$r8LRRIGD$FNAYYA-NH2 |
| 1620 | Ac-IWIAQALR$r8hLGDAFN$F4FYA-NH2 |
| 1621 | Ac-IWIAQALR$r8hLGDAFN$YF4FA-NH2 |
| 1622 | Ac-IWIAQALR$r8hLGDAFN$F4FF4FA-NH2 |
| 1623 | Ac-AWIAAALR$r8hLGDAFN$YF4FA-NH2 |
| 1624 | Ac-AWIAAALR$r8hLGDAFN$AF4FA-NH2 |
| 1625 | Ac-IWIAQAAR$r8hLGDAFN$F4FF4FA-NH2 |

In the sequences shown above and elsewhere, the following abbreviations are used: "Nle" represents norleucine, "Aib" represents 2-aminoisobutyric acid, "Ac" represents acetyl, and "Pr" represents propionyl. Amino acids represented as "$" are alpha-Me S5-pentenyl-alanine olefin amino acids connected by an all-carbon crosslinker comprising one double bond. Amino acids represented as "$r5" are alpha-Me R5-pentenyl-alanine olefin amino acids connected by an all-carbon comprising one double bond. Amino acids represented as "$s8" are alpha-Me S8-octenyl-alanine olefin amino acids connected by an all-carbon crosslinker comprising one double bond. Amino acids represented as "$r8" are alpha-Me R8-octenyl-alanine olefin amino acids connected by an all-carbon crosslinker comprising one double bond. "Ahx" represents an aminocyclohexyl linker. The crosslinkers are linear all-carbon crosslinker comprising eight or eleven carbon atoms between the alpha carbons of each amino acid. Amino acids represented as "$/" are alpha-Me S5-pentenyl-alanine olefin amino acids that are not connected by any crosslinker. Amino acids represented as "$/r5" are alpha-Me R5-pentenyl-alanine olefin amino acids that are not connected by any crosslinker. Amino acids represented as "$/s8" are alpha-Me S8-octenyl-alanine olefin amino acids that are not connected by any crosslinker. Amino acids represented as "$/r8" are alpha-Me R8-octenyl-alanine olefin amino acids that are not connected by any crosslinker. Amino acids represented as "Amw" are alpha-Me tryptophan amino acids. Amino acids represented as "Aml" are alpha-Me leucine amino acids. Amino acids represented as "Amf" are alpha-Me phenylalanine amino acids. Amino acids represented as "2ff" are 2-fluoro-phenylalanine amino acids. Amino acids represented as "3ff" are 3-fluoro-phenylalanine amino acids. Amino acids represented as "St" are amino acids comprising two pentenyl-alanine olefin side chains, each of which is crosslinked to another amino acid as indicated. Amino acids represented as "St//" are amino acids comprising two pentenyl-alanine olefin side chains that are not crosslinked. Amino acids represented as "% St" are amino acids comprising two pentenyl-alanine olefin side chains, each of which is crosslinked to another amino acid as indicated via fully saturated hydrocarbon crosslinks. Amino acids represented as "Ba" are beta-alanine. The lower-case character "e" or "z" within the designation of a crosslinked amino acid (e.g., "$er8" or "$zr8") represents the configuration of the double bond (E or Z, respectively). In other contexts, lower-case letters such as "a" or "f" represent D amino acids (e.g., D-alanine, or D-phenylalanine, respectively). Amino acids designated as "NmW" represent N-methyltryptophan. Amino acids designated as "NmY" represent N-methyltyrosine. Amino acids designated as "NmA" represent N-methylalanine. "Kbio" represents a biotin group attached to the side chain amino group of a lysine residue. Amino acids designated as "Sar" represent sarcosine. Amino acids designated as "Cha" represent cyclohexyl alanine. Amino acids designated as "Cpg" represent cyclopentyl glycine. Amino acids designated as "Chg" represent cyclohexyl glycine. Amino acids designated as "Cba" represent cyclobutyl alanine. Amino acids designated as "$F_4I$" represent 4-iodo phenylalanine. "7L" represents N15 isotopic leucine. Amino acids designated as "$F_3Cl$" represent 3-chloro phenylalanine. Amino acids designated as "F4cooh" represent 4-carboxy phenylalanine. Amino acids designated as "$F_3F_2$" represent 3,4-difluoro phenylalanine. Amino acids designated as "6clW" represent 6-chloro tryptophan. Amino acids designated as "$rda6" represent alpha-Me R6-hexynyl-alanine alkynyl amino acids, crosslinked via a dialkyne bond to a second alkynyl amino acid. Amino acids designated as "$da5" represent alpha-Me S5-pentynyl-alanine alkynyl amino acids, wherein the alkyne forms one half of a dialkyne bond with a second alkynyl amino acid. Amino acids designated as "$ra9" represent alpha-Me R9-nonynyl-alanine alkynyl amino acids, crosslinked via an alkyne metathesis reaction with a second alkynyl amino acid. Amino acids designated as "$a6" represent alpha-Me S6-hexynyl-alanine alkynyl amino acids, crosslinked via an alkyne metathesis reaction with a second alkynyl amino acid. The designation "iso1" or "iso2" indicates that the peptidomimetic macrocycle is a single isomer. Amino acids designated as "Cit" represent citrulline.

Amino acids which are used in the formation of triazole crosslinkers are represented according to the legend indicated below. Stereochemistry at the alpha position of each amino acid is S unless otherwise indicated. For azide amino acids, the number of carbon atoms indicated refers to the number of methylene units between the alpha carbon and the terminal azide. For alkyne amino acids, the number of carbon atoms indicated is the number of methylene units between the alpha position and the triazole moiety plus the two carbon atoms within the triazole group derived from the alkyne.

| | |
|---|---|
| $5a5 | Alpha-Me alkyne 1,5 triazole (5 carbon) |
| $5n3 | Alpha-Me azide 1,5 triazole (3 carbon) |
| $4rn6 | Alpha-Me R-azide 1,4 triazole (6 carbon) |
| $4a5 | Alpha-Me alkyne 1,4 triazole (5 carbon) |

In some embodiments, peptidomimetic macrocycles are provided which are derived from BIM. In some embodiments, the present invention provides a peptidomimetic macrocycle comprising an amino acid sequence which is at least about 60% identical to BIM, further comprising at least two macrocycle-forming linkers, wherein the first of said two macrocycle-forming linkers connects a first amino acid to a second amino acid, and the second of said two macrocycle-forming linkers connects a third amino acid to a fourth amino acid.

Two or more peptides can share a degree of homology. In some embodiments, the pair of peptides is a peptidomimetic macrocycle of the present disclosure and a peptide identical to BIM. A pair of peptides can have, for example, up to about 20% pairwise homology, up to about 25% pairwise homology, up to about 30% pairwise homology, up to about 35% pairwise homology, up to about 40% pairwise homology, up to about 45% pairwise homology, up to about 50% pairwise homology, up to about 55% pairwise homology, up to about 60% pairwise homology, up to about 65% pairwise homology, up to about 70% pairwise homology, up to about 75% pairwise homology, up to about 80% pairwise homology, up to about 85% pairwise homology, up to about 90% pairwise homology, up to about 95% pairwise homology, up to about 96% pairwise homology, up to about 97% pairwise homology, up to about 98% pairwise homology, up to about 99% pairwise homology, up to about 99.5% pairwise homology, or up to about 99.9% pairwise homology. A pair of peptides can have, for example, at least about 20% pairwise homology, at least about 25% pairwise homology, at least about 30% pairwise homology, at least about 35% pairwise homology, at least about 40% pairwise homology, at least about 45% pairwise homology, at least about 50% pairwise homology, at least about 55% pairwise homology, at least about 60% pairwise homology, at least about 65% pairwise homology, at least about 70% pairwise homology, at least about 75% pairwise homology, at least about 80% pairwise homology, at least about 85% pairwise homology, at least about 90% pairwise homology, at least about 95% pairwise homology, at least about 96% pairwise homology, at least about 97% pairwise homology, at least about 98% pairwise homology, at least about 99% pairwise homology, at least about 99.5% pairwise homology, at least about 99.9% pairwise homology.

Various methods and software programs can be used to determine the homology between two or more peptides, such as NCBI BLAST, Clustal W, MAFFT, Clustal Omega, AlignMe, Praline, or another suitable method or algorithm.

In some embodiments, a peptidomimetic macrocycle of the invention comprises a helix, for example an α-helix. In some embodiments, a peptidomimetic macrocycle of the invention comprises an α,α-disubstituted amino acid. In some embodiments, each amino acid connected by the macrocycle-forming linker is an α,α-disubstituted amino acid.

In some embodiments, a peptidomimetic macrocycle of the invention has the Formula (I):

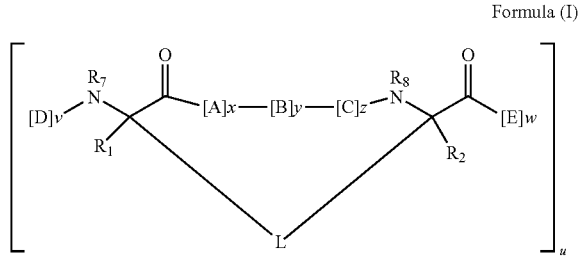

Formula (I)

wherein:

each A, C, D, and E is independently an amino acid (including natural or non-natural amino acids and amino acid analogs) and the terminal D and E independently optionally include a capping group;

each B is independently an amino acid (including natural or non-natural amino acids and amino acid analogs),

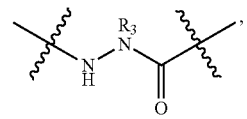

[—NH-$L_3$-CO—], [—NH-$L_3$-$SO_2$—], or [—NH-$L_3$-];

each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each L and L' is independently a macrocycle-forming linker of the formula -$L_1$-$L_2$-,

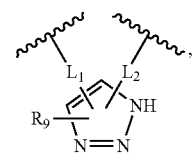

or -$L_1$-S-$L_2$-S-$L_3$-;

each $L_1$, $L_2$ and $L_3$ is independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$; when L is not

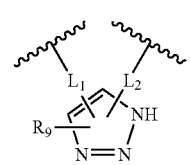

or -$L_1$-S-$L_2$-S-$L_3$-, $L_1$ and $L_2$ are alkylene, alkenylene, alkynylene, heteroalkylene, cycloalkylene, heterocycloalkylene, cycloarylene, or heterocycloarylene;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each $R_9$ is independently absent, hydrogen, alkyl, alkenyl, alkynyl, aryl, cycloalkyl, cycloalkenyl, heteroaryl, or heterocyclyl group, unsubstituted or optionally substituted with $R_a$ or $R_b$;

each $R_a$ and $R_b$ is independently alkyl, $OCH_3$, $CF_3$, $NH_2$, $CH_2NH_2$, F, Br, I,

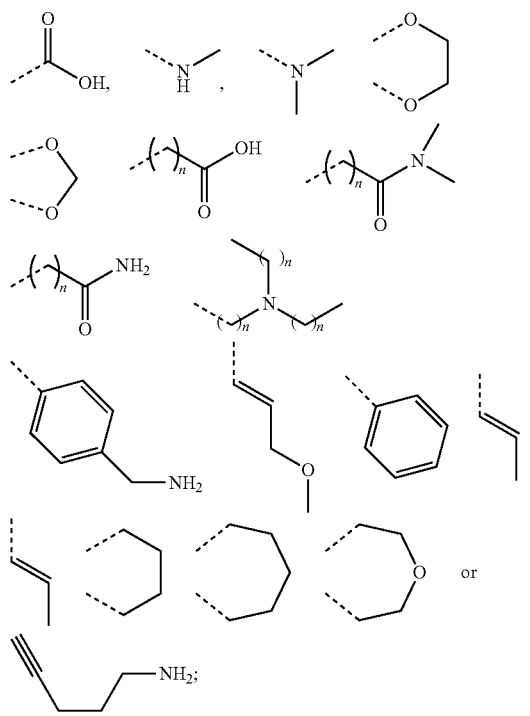

each v and w is independently an integer from 0-1000, for example 0-500, 0-200, 0-100, 0-50, 0-30, 0-20, or 0-10;

u is an integer from 1-10, for example 1-5, 1-3 or 1-2;

each x, y and z is independently an integer from 0-10, for example the sum of x+y+z is 2, 3, or 6;

each n is independently an integer from 1-5; and wherein A, B, C, D, and E, taken together with the cross-linked amino acids connected by the macrocycle-forming linker, -$L_1$-$L_2$-, form an amino acid sequence of the peptidomimetic macrocycle which is at least about 60%, 65%, 70%, 75%, 80%, 85%, 90%, 95%, 96%, 97%, 98%, or 99% identical to BIM 1-44, BIM 1-29 or to an amino acid sequence chosen from the group consisting of the amino acid sequences in Table 1;

In some embodiments, u is 1.

In some embodiments, the sum of x+y+z is 2, 3, 6, or 10, for example 2, 3 or 6, for example 3 or 6.

In some embodiments, the sum of x+y+z is 3.

In some embodiments, each of v and w is independently an integer from 1 to 10, 1 to 15, 1 to 20, or 1 to 25.

In some embodiments, each of v and w is independently an integer from 1 to 15.

In some embodiments, v and w are integers from 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, w is an integer from 3-10, for example 3-6, 3-8, 6-8, or 6-10. In some embodiments, w is 3. In other embodiments, w is 6. In some embodiments, v is an integer from 1-1000, for example 1-500, 1-200, 1-100, 1-50, 1-30, 1-20, or 1-10. In some embodiments, v is 2.

In some embodiments, $L_1$ and $L_2$ are independently alkylene, alkenylene or alkynylene.

In some embodiments, $L_1$ and $L_2$ are independently $C_3$-$C_{10}$ alkylene or alkenylene.

In some embodiments, $L_1$ and $L_2$ are independently $C_3$-$C_6$ alkylene or alkenylene.

In some embodiments, L or L' is:

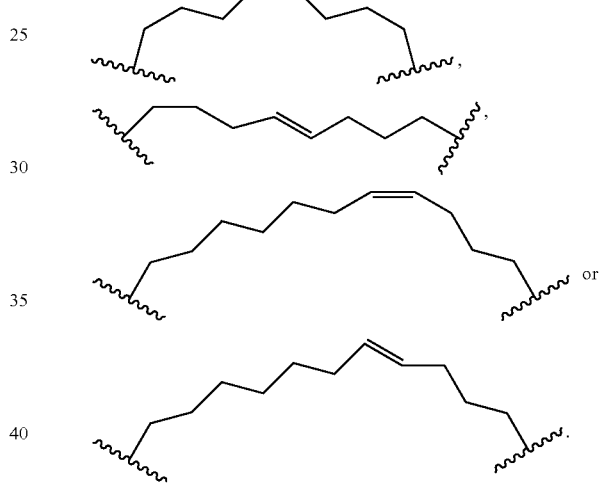

In some embodiments, L or L' is

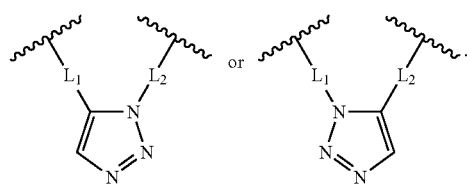

For example, L or L' is

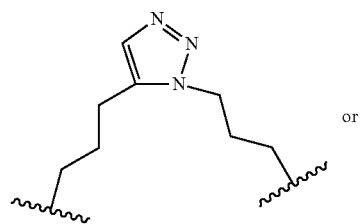

-continued

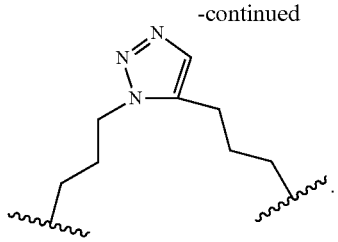

In some embodiments, $R_1$ and $R_2$ are H.
In some embodiments, $R_1$ and $R_2$ are independently alkyl.
In some embodiments, $R_1$ and $R_2$ are methyl.
In some embodiments, the present invention provides a peptidomimetic macrocycle having the Formula (Ia):

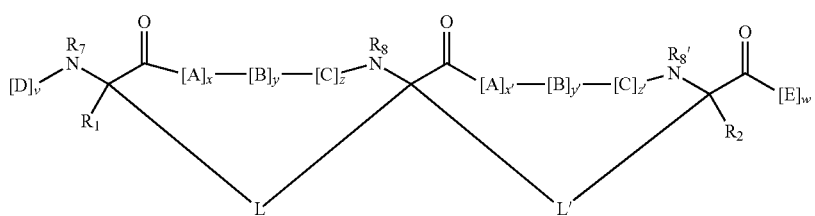

Formula (Ia)

wherein:
$R_8'$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a E residue;
v' and w' are independently integers from 0-100; and
x', y' and z' are independently integers from 0-10, for example, x'+y'+z' is 2, 3, 6 or 10.

In some embodiments, u is 2.
In some embodiments, the peptidomimetic macrocycle of Formula (I) has the Formula (Ib):

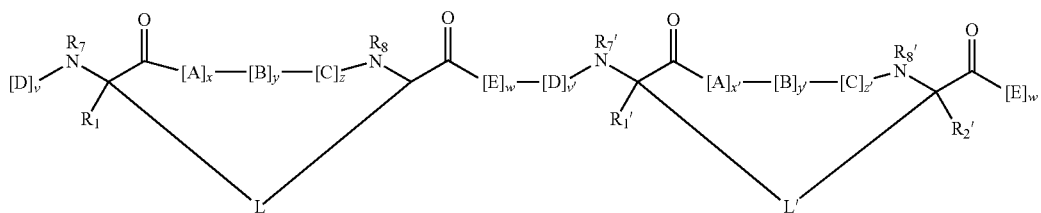

Formula (Ib)

wherein:
$R_7'$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;
$R_8'$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;
v' and w' are independently integers from 0-100; and
x', y' and z' are independently integers from 0-10.
In some embodiments, the sum of x+y+z is 2, 3 or 6, for example 3 or 6.
In some embodiments, the sum of x'+y'+z' is 2, 3 or 6, for example 3 or 6.

In some embodiments, each of v and w is independently an integer from 1 to 10, 1 to 15, 1 to 20, or 1 to 25.

In some embodiments, v and w are integers from 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, w is an integer from 3-10, for example 3-6, 3-8, 6-8, or 6-10. In some embodiments, w is 3. In other embodiments, w is 6. In some embodiments, v is an integer from 1-1000, for example 1-500, 1-200, 1-100, 1-50, 1-30, 1-20, or 1-10. In some embodiments, v is 2.

In some embodiments, a peptidomimetic macrocycle of the invention comprises an amino acid sequence which is at least about 60%, 65%, 70%, 75%, 80%, 85%, 90%, 95%, 96%, 97%, 98%, or 99% identical to an amino acid sequence of Table 1, and comprising at least one macrocycle-forming linker, wherein the macrocycle-forming linker connects amino acids 14 and 18.

In some embodiments, a peptidomimetic macrocycle of Formula (I) has Formula (Ic):

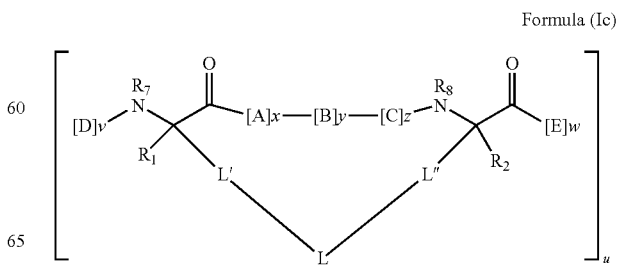

Formula (Ic)

wherein:

each A, C, D, and E is independently a natural or non-natural amino acid;

each B is independently a natural or non-natural amino acid, amino acid analog,

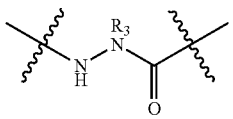

[—NH-L₃-CO—], [—NH-L₃-SO₂—], or [—NH-L₃-];

each L is independently a macrocycle-forming linker;

each L' is independently alkylene, alkenylene, alkynylene, heteroalkylene, cycloalkylene, heterocycloalkylene, arylene, or heteroarylene, each being optionally substituted with $R_5$, or a bond, or together with $R_1$ and the atom to which both $R_1$ and L' are bound forms a ring;

each L" is independently alkylene, alkenylene, alkynylene, heteroalkylene, cycloalkylene, heterocycloalkylene, arylene, or heteroarylene, each being optionally substituted with $R_5$, or a bond, or together with $R_2$ and the atom to which both $R_2$ and L" are bound forms a ring;

each $R_1$ is independently —H, alkyl, alkenyl, alkynyl, arylalkyl, cycloalkyl, cycloalkylalkyl, heteroalkyl, or heterocycloalkyl, unsubstituted or substituted with halo-, or together with L' and the atom to which both $R_1$ and L' are bound forms a ring;

each $R_2$ is independently —H, alkyl, alkenyl, alkynyl, arylalkyl, cycloalkyl, cycloalkylalkyl, heteroalkyl, or heterocycloalkyl, unsubstituted or substituted with halo-, or together with L" and the atom to which both $R_2$ and L" are bound forms a ring;

each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;

each $L_3$ is independently alkylene, alkenylene, alkynylene, heteroalkylene, cycloalkylene, heterocycloalkylene, arylene, heteroarylene, or [—$R_4$—K—$R_4$—]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, SO₂, CO, CO₂, or CONR₃;

n is an integer from 1-5;

each $R_5$ is independently halogen, alkyl, —OR₆, —N(R₆)₂, —SR₆, —SOR₆, —SO₂R₆, —CO₂R₆, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;

each v and w is independently an integer from 1-1000, for example 1-500, 1-200, 1-100, 1-50, 1-40, 1-25, 1-20, 1-15, or 1-10;

u is an integer from 1-10; and each x, y and z is independently an integer from 0-10.

In some embodiments, the peptidomimetic macrocycle comprises two crosslinks, wherein a first crosslink is of a first pair of amino acid residues, and a second crosslink is of a second pair of amino acid residues. In some embodiments, the first pair of amino acid residues and the second pair of amino acid residues do not share a common amino acid residue. In some embodiments, the first pair of amino acid residues and the second pair of amino acid residues share one common amino acid residue.

In some embodiments, w is at least about 1, at least about 2, at least about 3, at least about 4, at least about 5, at least about 6, at least about 7, at least about 8, at least about 9, or at least about 10. In some embodiments, w is from about 1 to about 2, from about 2 to about 3, from about 3 to about 4, from about 4 to about 5, from about 5 to about 6, from about 6 to about 7, from about 7 to about 8, from about 8 to about 9, or from about 9 to about 10.

In some embodiments, w is at least 2 and at least one of the last two E residues is a His residue. In some embodiments, w is at least 2 and at least one of the last two E residues is an Arg residue. In some embodiments, w is at least 2 and both of the last two E residues are His residues. In some embodiments, w is at least 2 and both of the last two E residues are Arg residues. The number of His residues at the peptide C-terminus, or at the E variable, can be 1, 2, 3, 4, 5, 6, 7, 8, 9, or 10. The His residues can be contiguous, or interrupted by a gap of i, i+1, i+2, i+3, or i+4.

In some embodiments, the peptidomimetic macrocycle comprises a helix. In some embodiments, the peptidomimetic macrocycle comprises an α-helix. In some embodiments, each of v and w is independently an integer from 1 to 15. In some embodiments, each of v and w is independently an integer from 3 to 10. In some embodiments, v is 8. In some embodiments, w is 6. In some embodiments, the crosslinked amino acid residues are at positions 9 and 13 of the peptidomimetic macrocycle.

In some embodiments, L is

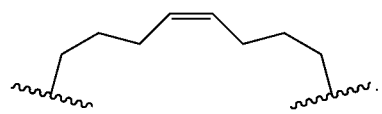 [SMILES: *CCC/C=C\CCC*]

In some embodiments, $R^1$ and $R^2$ are H. In some embodiments, $R^1$ and $R^2$ are independently alkyl. In some embodiments, $R^1$ and $R^2$ are methyl.

In some embodiments, the peptidomimetic macrocycles have the Formula (I):

Formula (I)

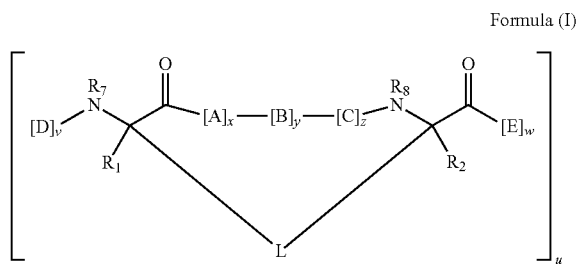

wherein:

each A, C, D, and E is independently a natural or non-natural amino acid;

each B is independently a natural or non-natural amino acid, amino acid analog,

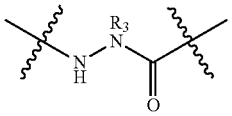

[—NH-L$_3$-CO—], [—NH-L$_3$-SO$_2$—], or [—NH-L$_3$-];

each R$_1$ and R$_2$ is independently —H, alkyl, alkenyl, alkynyl, arylalkyl, cycloalkyl, cycloalkylalkyl, heteroalkyl, or heterocycloalkyl, unsubstituted or substituted with halo-;

each R$_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with R$_5$;

each L is independently a macrocycle-forming linker of the formula

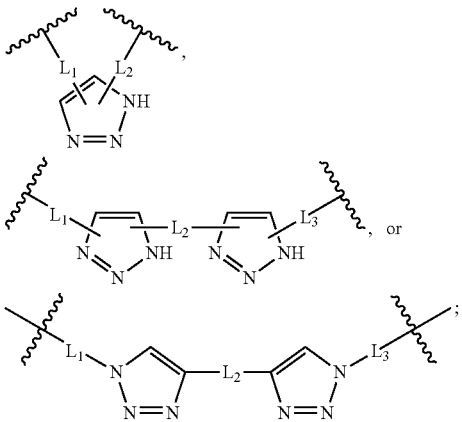

each L$_1$, L$_2$ and L$_3$ is independently alkylene, alkenylene, alkynylene, heteroalkylene, cycloalkylene, heterocycloalkylene, arylene, heteroarylene, or [—R$_4$—K—R$_4$—]$_n$, each being optionally substituted with R$_5$;

each R$_4$ is independently alkylene, alkenylene, alkynylene, heteroalkylene, cycloalkylene, heterocycloalkylene, arylene, or heteroarylene;

each K is independently O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

each R$_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with a D residue;

each R$_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with an E residue;

each v and w is independently an integer from 1-1000;
u is an integer from 1-10;
each x, y and z is independently an integer from 0-10; and
n is an integer from 1-5.

In other embodiments, provided are peptidomimetic macrocycles comprising Formula (II) or (IIa):

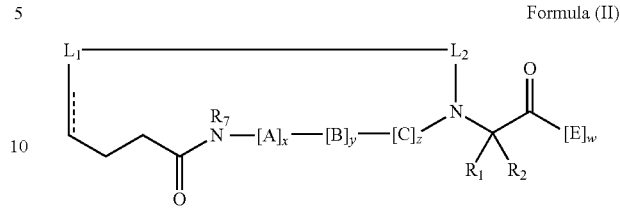
Formula (II)

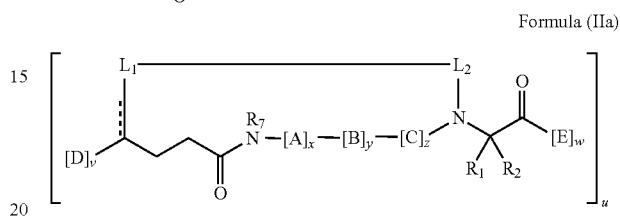
Formula (IIa)

wherein:
each A, C, D, and E is independently a natural or non-natural amino acid, and the terminal D and E independently optionally include a capping group;

each B is independently a natural or non-natural amino acid, amino acid analog,

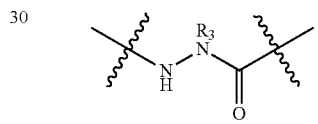

[—NH-L$_3$-CO—], [—NH-L$_3$-SO$_2$—], or [—NH-L$_3$-];

each R$_1$ and R$_2$ is independently —H, alkyl, alkenyl, alkynyl arylalkyl cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

each R$_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each L$_1$, L$_2$, and L$_3$ is independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

each R$_4$ is independently alkylene, alkenylene, alkynylene, heteroalkylene, cycloalkylene, heterocycloalkylene, arylene, or heteroarylene;

each K is independently O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

each R$_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$;

each v and w is independently an integer from 0-100;
u is an integer from 1-10;

each x, y and z is independently an integer from 0-10;
n is an integer from 1-5; and A, B, C, and E, taken together with the crosslinked amino acids connected by the macrocycle-forming linker -$L_1$-$L_2$-, form an amino acid sequence of the peptidomimetic macrocycle which is at least about 60%, 65%, 70%, 75%, 80%, 85%, 90%, 95%, 96%, 97%, 98%, 99%, or 100% identical to a sequence of Table 1.

In some embodiments, a peptidomimetic macrocycle comprises Formula (IIIa) or (IIIb):

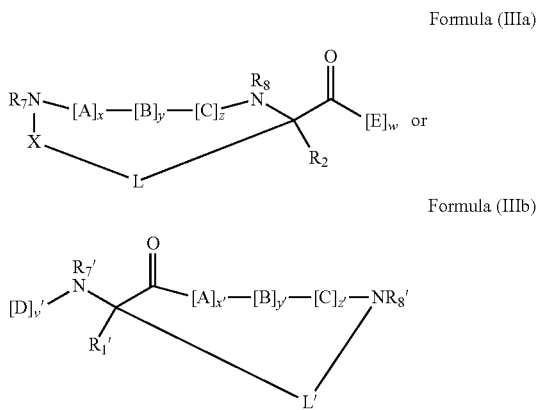

Formula (IIIa)

Formula (IIIb)

wherein:

each A, C, D and E is independently an amino acid, and the terminal D and E independently optionally include a capping group;

each B is independently an amino acid,

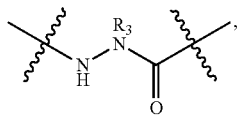

[—NH-$L_3$-CO—], [—NH-$L_3$-$SO_2$—], or [—NH-$L_3$—];

each $R_1'$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or $R_2$ forms a macrocycle-forming linker L' connected to the alpha position of one of said E amino acids;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each L and L' is independently a macrocycle-forming linker of the formula -$L_1$-$L_2$-,

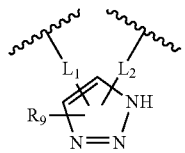

or -$L_1$-S-$L_2$-S-$L_3$-;

each $L_1$, $L_2$ and $L_3$ is independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ or $R_7'$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ or $R_8'$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each $R_9$ is independently absent, hydrogen, alkyl, alkenyl, alkynyl, aryl, cycloalkyl, cycloalkenyl, heteroaryl, or heterocyclyl group, unsubstituted or optionally substituted with $R_a$ or $R_b$;

each $R_a$ and $R_b$ is independently alkyl, $OCH_3$, $CF_3$, $NH_2$, $CH_2NH_2$, F, Br, I,

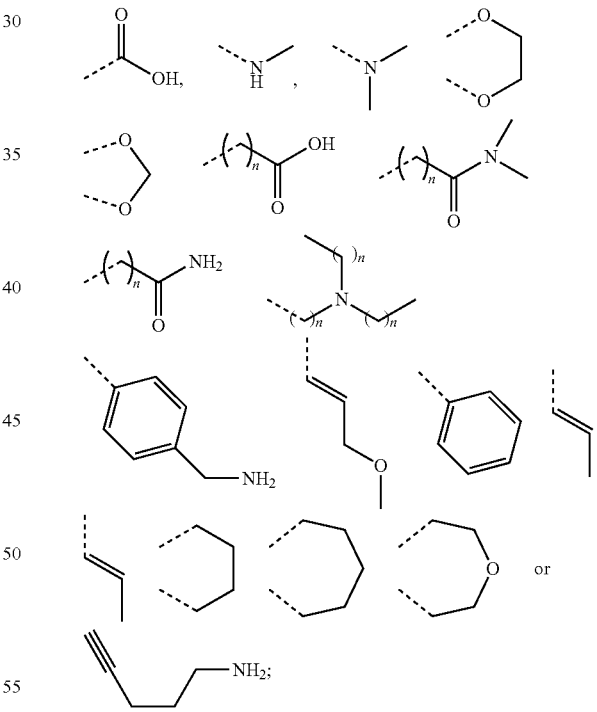

each v' and w is independently an integer from 0-1000, for example 0-500, 0-200, 0-100, 0-50, 0-30, 0-20, or 0-10;

u is an integer from 1-10, for example 1-5, 1-3 or 1-2;

each x, y, z, x', y' and z' is independently an integer from 0-10, for example the sum of x+y+z is 2, 3, 6 or 10, or the sum of x'+y'+z' is 2, 3, 6, or 10;

n is an integer from 1-5;

X is C=O, $CHR_c$, or C=S;

$R_c$ is alkyl, alkenyl, alkynyl, arylalkyl, cycloalkyl, cycloalkylalkyl, heteroalkyl, or heterocycloalkyl; and A, B, C, and E, taken together with the crosslinked amino acids connected by the macrocycle-forming linker -L$_1$-L$_2$-, form an amino acid sequence of the peptidomimetic macrocycle which is at least about 60%, 65%, 70%, 75%, 80%, 85%, 90%, 95%, 96%, 97%, 98%, 99%, or 100% identical to a sequence of Table 1.
In some embodiments, the peptidomimetic macrocycle has the Formula:
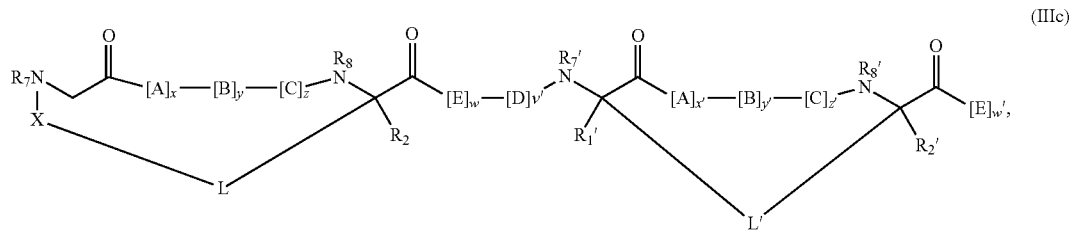
(IIIc)
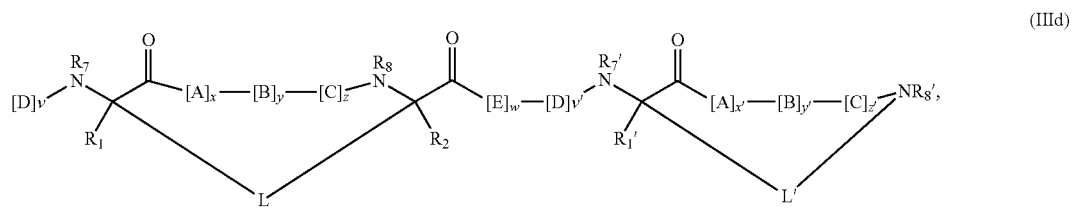
(IIId)
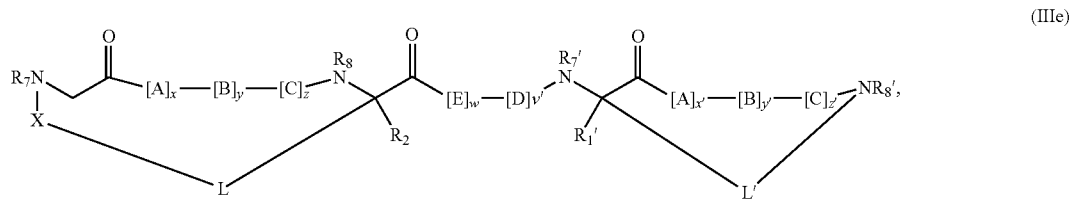
(IIIe)
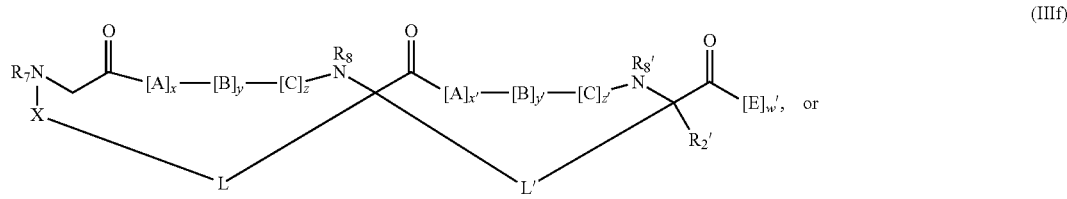
(IIIf)
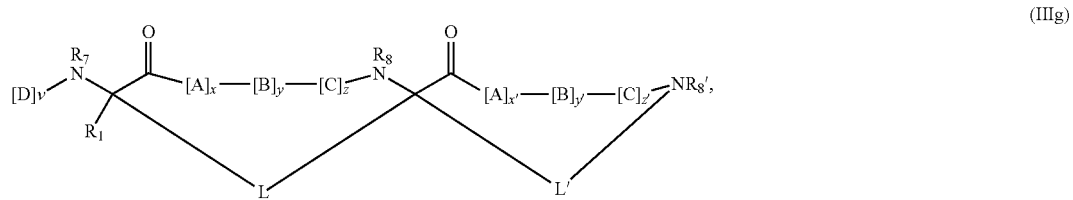
(IIIg)

wherein:
each $R_1'$ or $R_2'$ is independently —H, alkyl, alkenyl, alkynyl arylalkyl cycloalkyl cycloalkylalkyl, heteroalkyl, or heterocycloalkyl, unsubstituted or substituted with halo-; and each v, w, v' or w' is independently an integer from 0-100.

In some embodiments, the notation "Hep" is used for a macrocycle of Formula IIIa, which represents an N-terminal heptenoic capping group of the following formula:

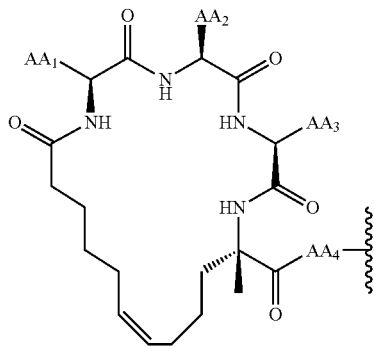

wherein $AA_1$, $AA_2$, $AA_3$ and $AA_4$ are amino acids.

In other embodiments, a C-terminal macrocycle of Formula IIIb forms the structure:

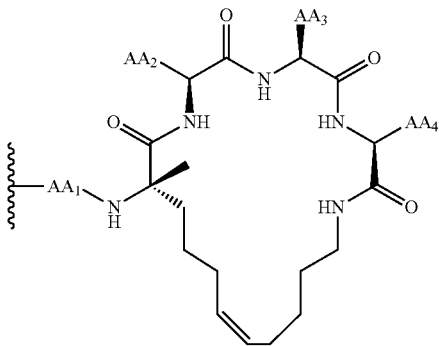

In some embodiments, the peptidomimetic macrocycle has the Formula IV:

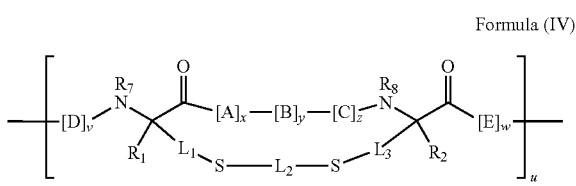

Formula (IV)

wherein:
each A, C, D, and E is independently an amino acid;
each B is independently an amino acid,

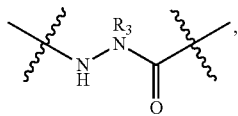

[—NH-$L_4$-CO—], [—NH-$L_4$-$SO_2$—], or [—NH-$L_4$-];
each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $L_1$, $L_2$, $L_3$ and $L_4$ is independently alkylene, alkenylene, alkynylene, heteroalkylene, cycloalkylene, heterocycloalkylene, cycloarylene, heterocycloarylene or [—$R_4$—K—$R_4$-]n, each being unsubstituted or substituted with $R_5$;

each K is independently O, S, SO, $SO_2$, CO, $CO_2$, or $CONR_3$;

each $R_4$ is independently alkylene, alkenylene, alkynylene, heteroalkylene, cycloalkylene, heterocycloalkylene, arylene, or heteroarylene;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each v and w is independently an integer from 1-1000, for example 1-500, 1-200, 1-100, 1-50, 1-30, 1-20 or 1-10;

u is an integer from 1-10, for example 1-5, 1-3 or 1-2;

each x, y and z is independently an integer from 0-10, for example the sum of x+y+z is 2, 3, 6 or 10, for example sum of x+y+z is 2, 3 or 6; and n is an integer from 1-5.

In some embodiments, the peptidomimetic macrocycle has the Formula (V):

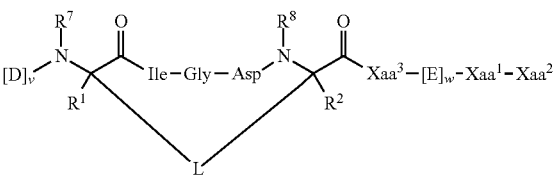

Formula (V)

wherein:
each D and E is independently an amino acid residue;
$R^1$ and $R^2$ are independently —H, alkyl, alkenyl, alkynyl, arylalkyl, cycloalkyl, cycloalkylalkyl, heteroalkyl, or heterocycloalkyl, each being optionally substituted with halo-; or at least one of $R^1$ and $R^2$ forms a macrocycle-forming linker L' connected to the alpha position of one of the D or E amino acid residues;

each L or L' is independently a macrocycle-forming linker of the formula -$L^1$-$L^2$- or -$L^1$-$L^2$-$L^3$-;

each $L^1$, $L^2$, and $L^3$ is independently alkylene, alkenylene, alkynylene, heteroalkylene, cycloalkylene, heterocycloalkylene, arylene, heteroarylene, or [—R$^4$—K—R$^4$—]$_n$, each being optionally substituted with R$^5$;

each R$^3$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with R$^5$;

each R$^4$ is independently alkylene, alkenylene, alkynylene, heteroalkylene, cycloalkylene, heterocycloalkylene, arylene, or heteroarylene, each being optionally substituted with R$^5$;

each K is independently O, S, SO, SO$_2$, CO, CO$_2$, or CONR$^3$;

each R$^5$ is independently halogen, alkyl, —OR$^6$, —N(R$^6$)$_2$, —SR$^6$, —SOR$^6$, —SO$_2$R$^6$, —CO$_2$R$^6$, a fluorescent moiety, a radioisotope, or a therapeutic agent;

each R$^6$ is independently —H, alkyl, alkenyl, alkynyl, arylalkyl, cycloalkylalkyl, heterocycloalkyl, a fluorescent moiety, a radioisotope, or a therapeutic agent;

R$^7$ is —H, alkyl, alkenyl, alkynyl, arylalkyl, cycloalkyl, heteroalkyl, cycloalkylalkyl, heterocycloalkyl, aryl, or heteroaryl, each being optionally substituted with R$^5$, or part of a cyclic structure with a D residue;

R$^8$ is —H, alkyl, alkenyl, alkynyl, arylalkyl, cycloalkyl, heteroalkyl, cycloalkylalkyl, heterocycloalkyl, aryl, or heteroaryl, each being optionally substituted with R$^5$, or part of a cyclic structure with an E residue;

each of Xaa$^1$ and Xaa$^2$ is independently an amino acid residue or absent;

Xaa$^3$ is Ala, Aib, Asp, Asn, Cys, Glu, Gln, His, Ile, Lys, Leu, Met, Arg, Ser, Thr, Val, Trp, Tyr, or an analogue of any of the foregoing;

v is an integer from 1-1000;

w is an integer from 0-1000; and n is an integer from 1-5.

In some embodiments, the peptidomimetic macrocycle of Formula (V) comprises two crosslinks, wherein a first crosslink is of a first pair of amino acid residues, and a second crosslink is of a second pair of amino acid residues. In some embodiments, the first pair of amino acid residues and the second pair of amino acid residues do not share a common amino acid residue. In some embodiments, the first pair of amino acid residues and the second pair of amino acid residues share one common amino acid residue. In some embodiments, one of Xaa$^1$ and Xaa$^2$ is His. In some embodiments, both of Xaa$^1$ and Xaa$^2$ are His. In some embodiments, one of Xaa$^1$ and Xaa$^2$ is Arg. In some embodiments, both of Xaa$^1$ and Xaa$^2$ are Arg. In some embodiments, one of Xaa$^1$ and Xaa$^2$ is absent. In some embodiments, both of Xaa$^1$ and Xaa$^2$ are absent.

In some embodiments, the peptidomimetic macrocycle comprises a helix. In some embodiments, the peptidomimetic macrocycle comprises an α-helix. In some embodiments, v is an integer from 1 to 15. In some embodiments, v is an integer from 3 to 10. In some embodiments, v is 8. In some embodiments, w is an integer from 0 to 15. In some embodiments, w is an integer from 0 to 5. In some embodiments, w is an integer from 0 to 3. In some embodiments, wherein w is 0.

In some embodiments, v and w are integers from 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, w is an integer from 3-10, for example 3-6, 3-8, 6-8, or 6-10. In some embodiments, w is 3. In other embodiments, w is 6. In some embodiments, v is an integer from 1-1000, for example 1-500, 1-200, 1-100, 1-50, 1-30, 1-20, or 1-10. In some embodiments, v is 2.

In some embodiments, L is the formula -L$^1$-L$^2$-, and L$^1$ and L$^2$ are independently alkylene, alkenylene, or alkynylene. In some embodiments, wherein L is the formula -L$^1$-L$^2$-, and L$^1$ and L$^2$ are independently C$_3$-C$_{10}$ alkylene or C$_3$-C$_{10}$ alkenylene. In some embodiments, wherein L is the formula -L$^1$-L$^2$-, and L$^1$ and L$^2$ are independently C$_3$-C$_6$ alkylene or C$_3$-C$_6$ alkenylene. In some embodiments, L is

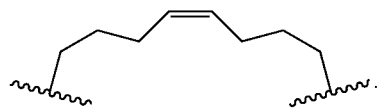

In some embodiments, L is the formula -L$^1$-L$^2$-L$^3$-, and L$^1$ and L$^3$ are independently alkylene, alkenylene, or alkynylene, and L$^2$ is arylene or heteroarylene. In some embodiments, L is the formula -L$^1$-L$^2$-L$^3$-, and L$^1$ and L$^3$ are independently C$_3$-C$_{10}$ alkylene, and L$^2$ is heteroarylene. In some embodiments, L is the formula -L$^1$-L$^2$-L$^3$-, and L$^1$ and L$^3$ are independently C$_3$-C$_6$ alkylene, and L$^2$ is heteroarylene.

In some embodiments, R$^1$ and R$^2$ are H. In some embodiments, R$^1$ and R$^2$ are independently alkyl. In some embodiments, R$^1$ and R$^2$ are methyl.

In some embodiments, the peptidomimetic macrocycle has the Formula (VI) (SEQ ID NO: 1783):

Formula (VI)

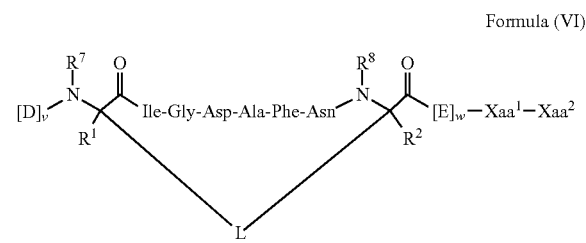

wherein:

each D and E is independently an amino acid residue;

R$^1$ and R$^2$ are independently —H, alkyl, alkenyl, alkynyl, arylalkyl, cycloalkyl, cycloalkylalkyl, heteroalkyl, or heterocycloalkyl, each being optionally substituted with halo-; or at least one of R$^1$ and R$^2$ forms a macrocycle-forming linker L' connected to the alpha position of one of the D or E amino acid residues;

each L or L' is independently a macrocycle-forming linker of the formula -L$^1$-L$^2$- or -L$^1$-L$^2$-L$^3$-;

each L$^1$, L$^2$, and L$^3$ is independently alkylene, alkenylene, alkynylene, heteroalkylene, cycloalkylene, heterocycloalkylene, arylene, heteroarylene, or [—R$^4$—K—R$^4$—], each being optionally substituted with R$^5$;

each R$^3$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with R$^5$;

each R$^4$ is independently alkylene, alkenylene, alkynylene, heteroalkylene, cycloalkylene, heterocycloalkylene, arylene, or heteroarylene, each being optionally substituted with R$^5$;

each K is independently O, S, SO, SO$_2$, CO, CO$_2$, or CONR$^3$;

each $R^5$ is independently halogen, alkyl, —$OR^6$, —$N(R^6)_2$, —$SR^6$, —$SOR^6$, —$SO_2R^6$, —$CO_2R^6$, a fluorescent moiety, a radioisotope, or a therapeutic agent;

each $R^6$ is independently —H, alkyl, alkenyl, alkynyl, arylalkyl, cycloalkylalkyl, heterocycloalkyl, a fluorescent moiety, a radioisotope, or a therapeutic agent;

$R^7$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with a D residue;

$R^8$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with an E residue;

each of $Xaa^1$ and $Xaa^2$ is independently an amino acid residue or absent;

v is an integer from 1-1000;

w is an integer from 0-1000; and n is an integer from 1-5.

In some embodiments, the peptidomimetic macrocycle of Formula (VI) comprises two crosslinks, wherein a first crosslink is of a first pair of amino acid residues, and a second crosslink is of a second pair of amino acid residues. In some embodiments, the first pair of amino acid residues and the second pair of amino acid residues do not share a common amino acid residue. In some embodiments, the first pair of amino acid residues and the second pair of amino acid residues share one common amino acid residue. In some embodiments, one of $Xaa^1$ and $Xaa^2$ is His. In some embodiments, both of $Xaa^1$ and $Xaa^2$ are His. In some embodiments, one of $Xaa^1$ and $Xaa^2$ is Arg. In some embodiments, both of $Xaa^1$ and $Xaa^2$ are Arg. In some embodiments, one of $Xaa^1$ and $Xaa^2$ is absent. In some embodiments, both of $Xaa^1$ and $Xaa^2$ are absent.

In some embodiments, the peptidomimetic macrocycle comprises a helix. In some embodiments, the peptidomimetic macrocycle comprises an α-helix. In some embodiments, v is an integer from 1 to 15. In some embodiments, v is an integer from 3 to 10. In some embodiments, v is 8. In some embodiments, w is an integer from 0 to 15. In some embodiments, w is an integer from 0 to 5. In some embodiments, w is an integer from 0 to 3. In some embodiments, wherein w is 0.

In some embodiments, v and w are integers from 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, w is an integer from 3-10, for example 3-6, 3-8, 6-8, or 6-10. In some embodiments, w is 3. In other embodiments, w is 6. In some embodiments, v is an integer from 1-1000, for example 1-500, 1-200, 1-100, 1-50, 1-30, 1-20, or 1-10. In some embodiments, v is 2.

In some embodiments, L is the formula -$L^1$-$L^2$-, and $L^1$ and $L^2$ are independently alkylene, alkenylene, or alkynylene. In some embodiments, wherein L is the formula -$L^1$-$L^2$-, and $L^1$ and $L^2$ are independently $C_3$-$C_{10}$ alkylene or $C_3$-$C_{10}$ alkenylene. In some embodiments, wherein L is the formula -$L^1$-$L^2$-, and $L^1$ and $L^2$ are independently $C_3$-$C_6$ alkylene or $C_3$-$C_6$ alkenylene. In some embodiments, L is

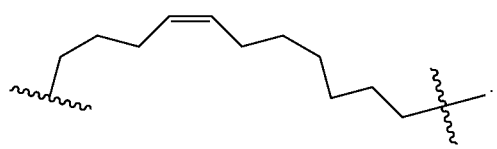 [SMILES: *CCC/C=C\CCCCCC*]

In some embodiments, L is the formula -$L^1$-$L^2$-$L^3$-, and $L^1$ and $L^3$ are independently alkylene, alkenylene, or alkynylene, and $L^2$ is arylene or heteroarylene. In some embodiments, L is the formula -$L^1$-$L^2$-$L^3$-, and $L^1$ and $L^3$ are independently $C_3$-$C_{10}$ alkylene, and $L^2$ is heteroarylene. In some embodiments, L is the formula -$L^1$-$L^2$-$L^3$-, and $L^1$ and $L^3$ are independently $C_3$-$C_6$ alkylene, and $L^2$ is heteroarylene.

In some embodiments, $R^1$ and $R^2$ are H. In some embodiments, $R^1$ and $R^2$ are independently alkyl. In some embodiments, $R^1$ and $R^2$ are methyl.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments of the invention, the sum of the sum of x+y+z is at least 3, or the sum of x'+y'+z' is at least 3. In other embodiments of the invention, the sum of the sum of x+y+z is 1, 2, 3, 4, 5, 6, 7, 8, 9 or 10 (for example 2, 3 or 6) or the sum of x'+y'+z' is 1, 2, 3, 4, 5, 6, 7, 8, 9 or 10 (for example 2, 3 or 6).

Each occurrence of A, B, C, D or E in a macrocycle or macrocycle precursor of the invention is independently selected. For example, a sequence represented by the formula $[A]_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound of the invention may encompass peptidomimetic macrocycles which are the same or different. For example, a compound of the invention may comprise peptidomimetic macrocycles comprising different linker lengths or chemical compositions.

In some embodiments, the peptidomimetic macrocycle of the invention comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

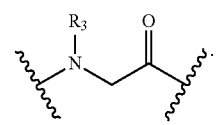

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In one embodiment, the peptidomimetic macrocycle of Formula (I) is:

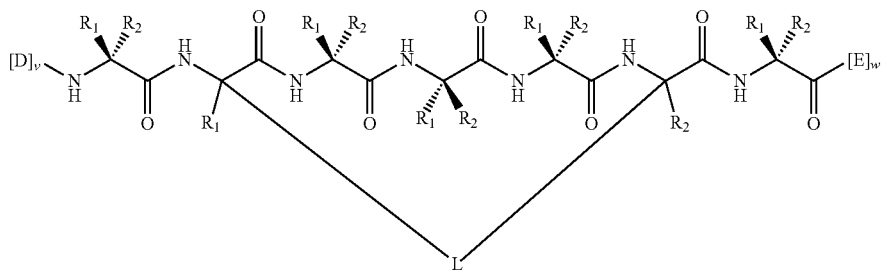

wherein each $R_1$ and $R_2$ is independently independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle comprises a structure of Formula (I) which is:

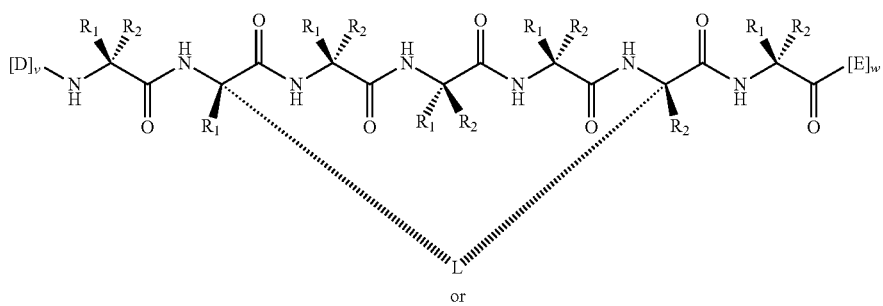

or

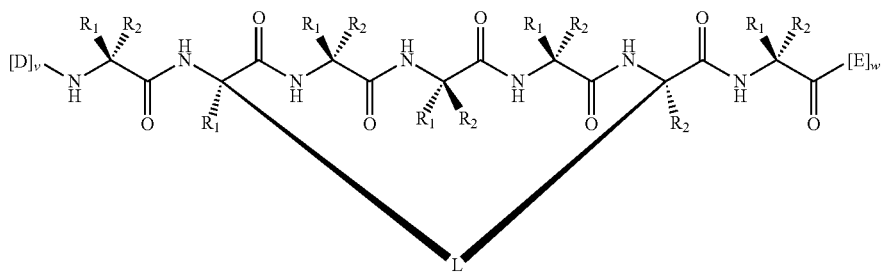

In other embodiments, the peptidomimetic macrocycle of Formula (I) is a compound of any of the formulas shown below:

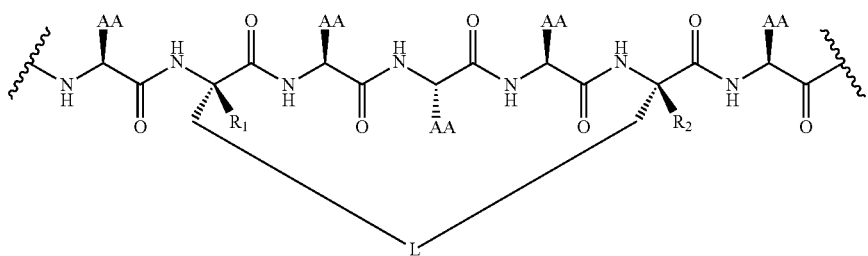

-continued
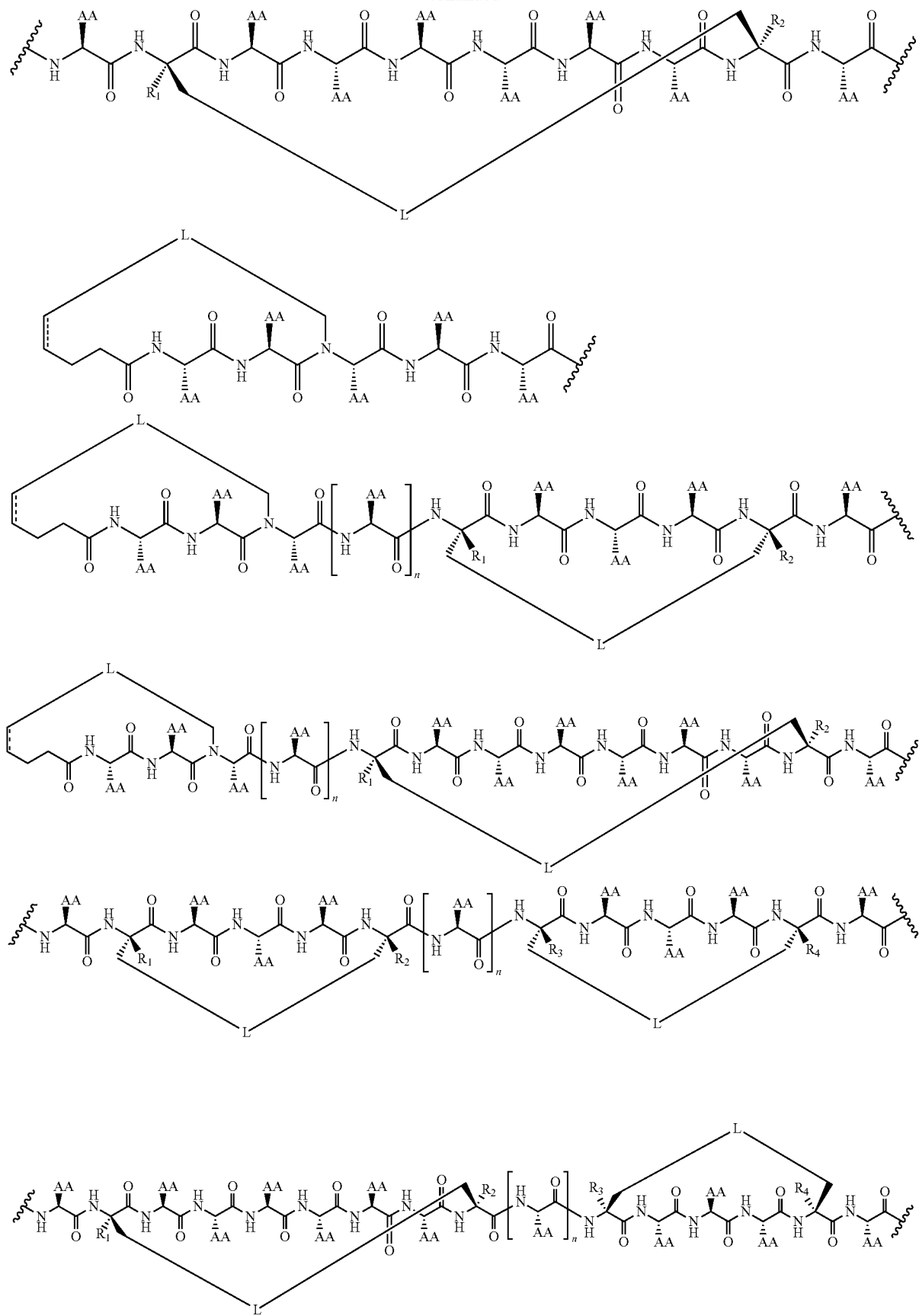

-continued
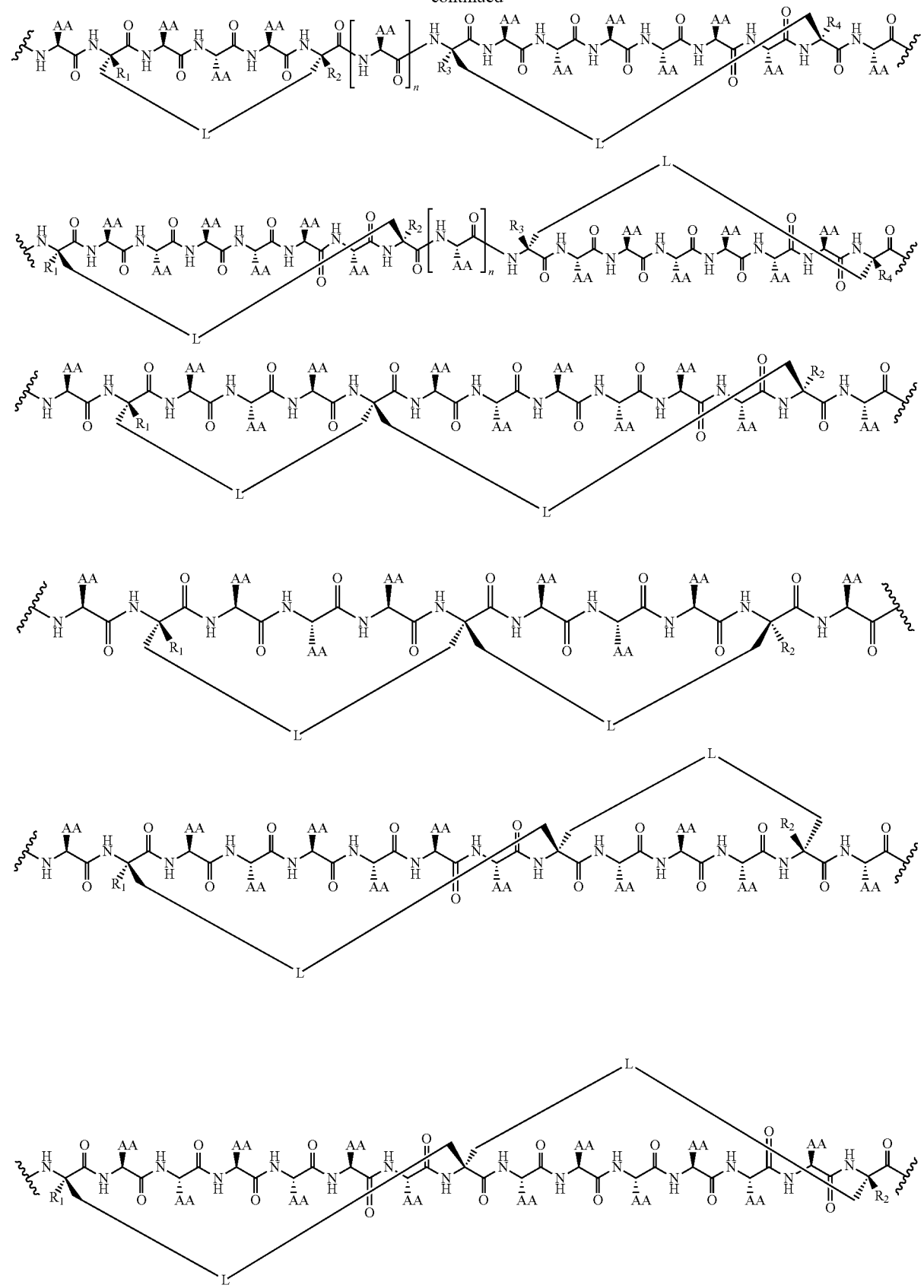

wherein "AA" represents any natural or non-natural amino acid side chain and " ͷ " is [D]$_v$, [E]$_w$ as defined above, and n is an integer between 0 and 20, 50, 100, 200, 300, 400 or 500. In some embodiments, the substituent "n" shown in the preceding paragraph is 0. In other embodiments, the substituent "n" shown in the preceding paragraph is less than 50, 40, 30, 20, 10, or 5.

Exemplary embodiments of the macrocycle-forming linker L are shown below.

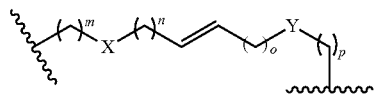

where X, Y = -CH$_2$-, O, S, or NH
m, n, o, p = 0-10

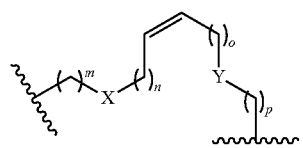

where X, Y = -CH$_2$-, O, S, or NH
m, n, o, p = 0-10

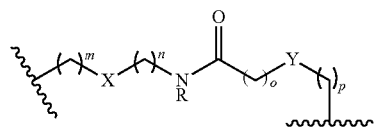

where X, Y = -CH$_2$-, O, S, or NH
m, n, o, p = 0-10
R = H, alkyl, other substituent

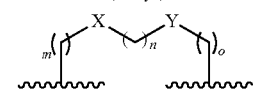

where X, Y = -CH$_2$-, O, S, or NH
m, n, o, p = 0-10

In other embodiments, D or E in the compound of Formula I are further modified in order to facilitate cellular uptake. In some embodiments, lipidating or PEGylating a peptidomimetic macrocycle facilitates cellular uptake, increases bioavailability, increases blood circulation, alters pharmacokinetics, decreases immunogenicity or decreases the needed frequency of administration.

In other embodiments, at least one of [D] and [E] in the compound of Formula I represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers.

In the peptidomimetic macrocycles of the invention, any of the macrocycle-forming linkers described herein may be used in any combination with any of the sequences shown in Tables 1-2 and also with any of the R— substituents indicated herein.

In some embodiments, the peptidomimetic macrocycle comprises at least one α-helix motif. For example, A, B or C in the compound of Formula I include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the mac- rocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

In some embodiments, L is a macrocycle-forming linker of the formula

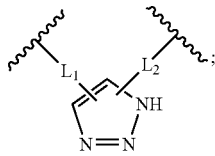

Exemplary embodiments of such macrocycle-forming linkers L are shown below.

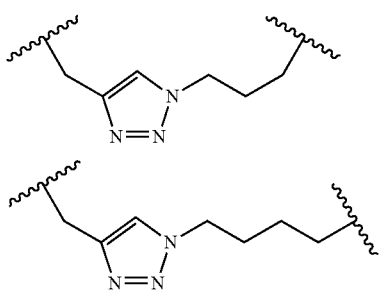
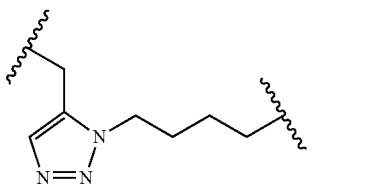
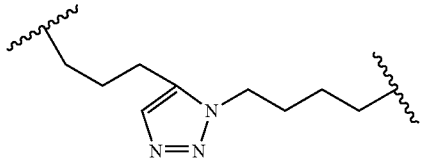
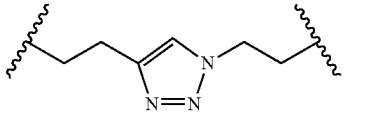
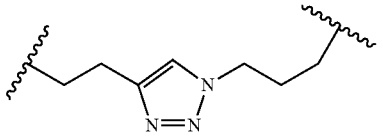
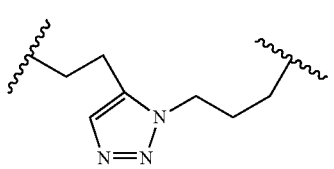

-continued

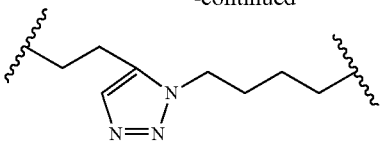
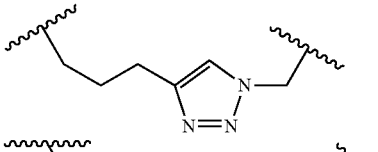
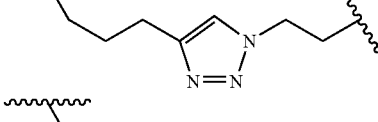
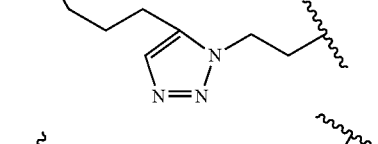
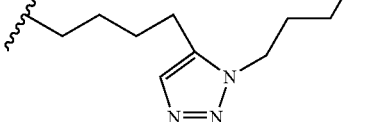
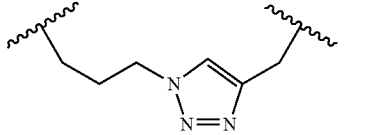
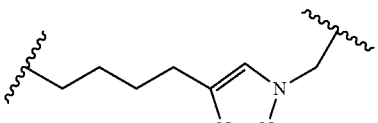
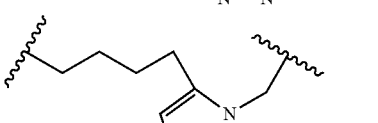
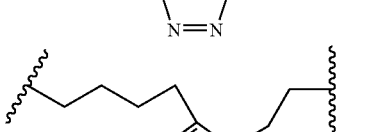
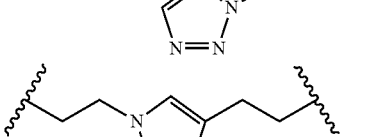
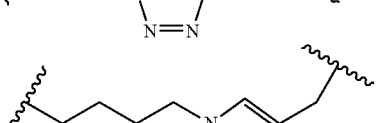
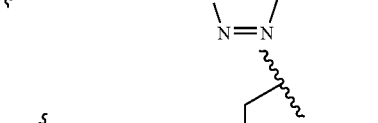
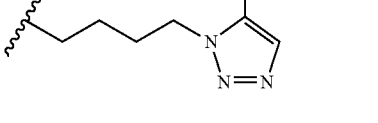

107
-continued
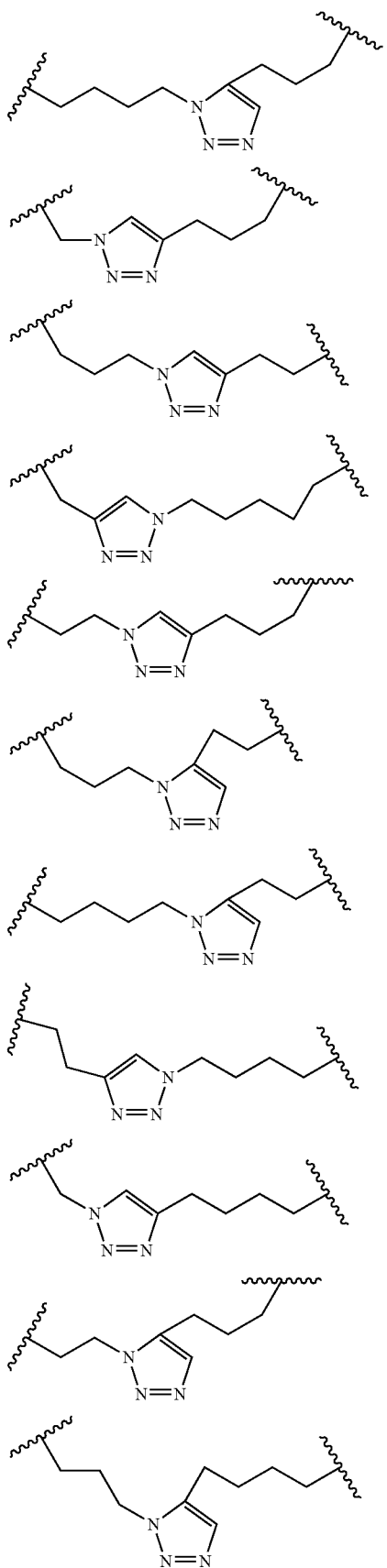
108
-continued
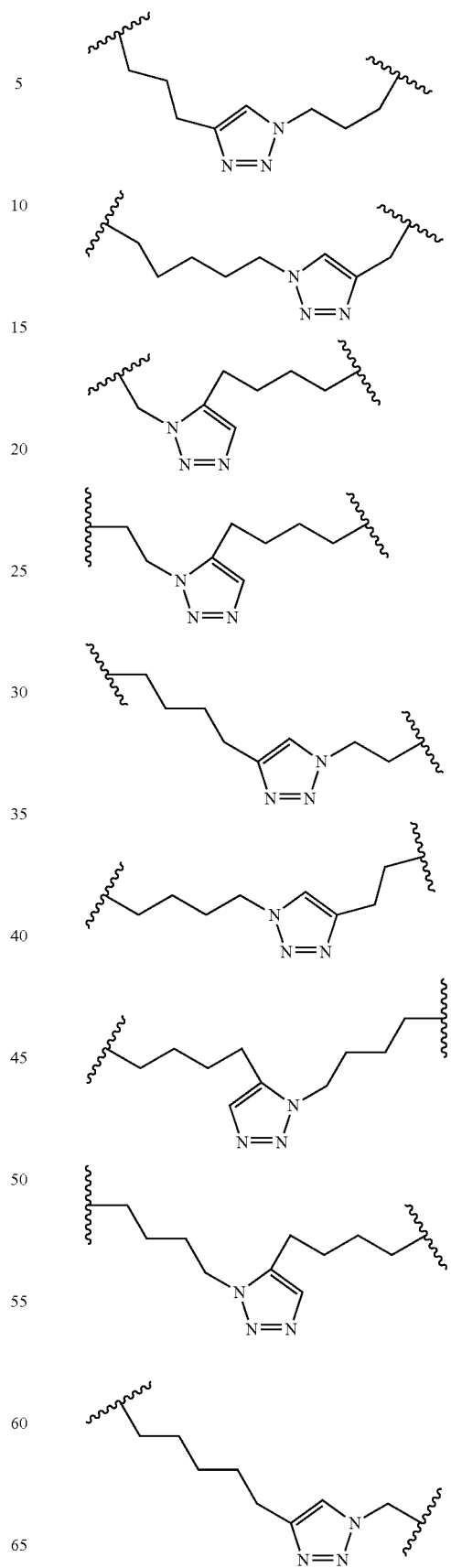

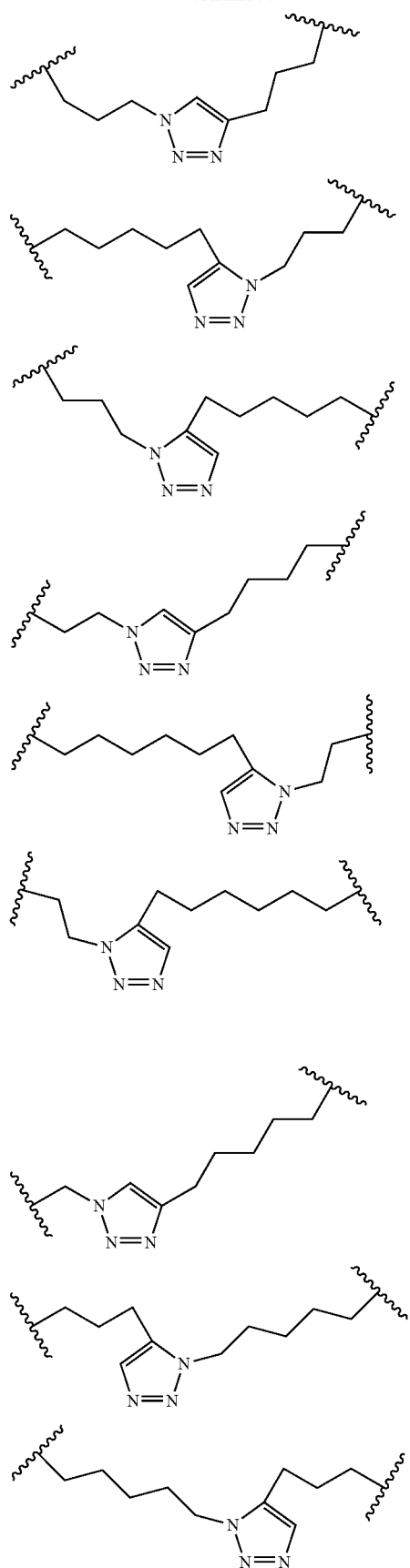
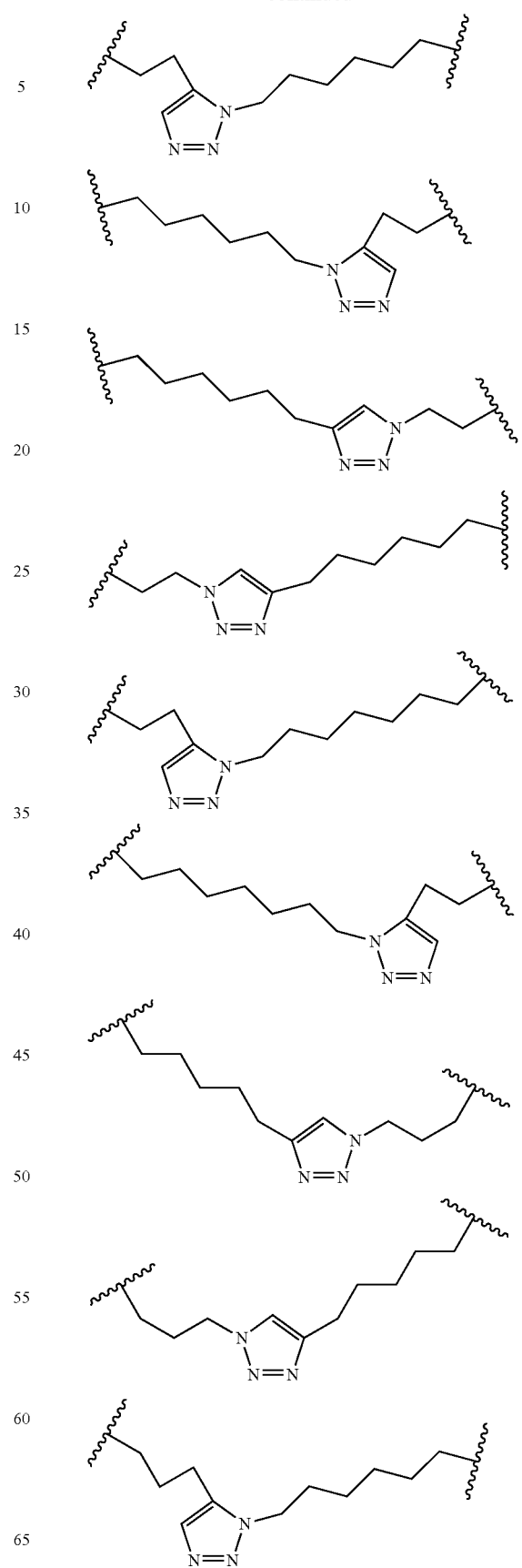

111
-continued
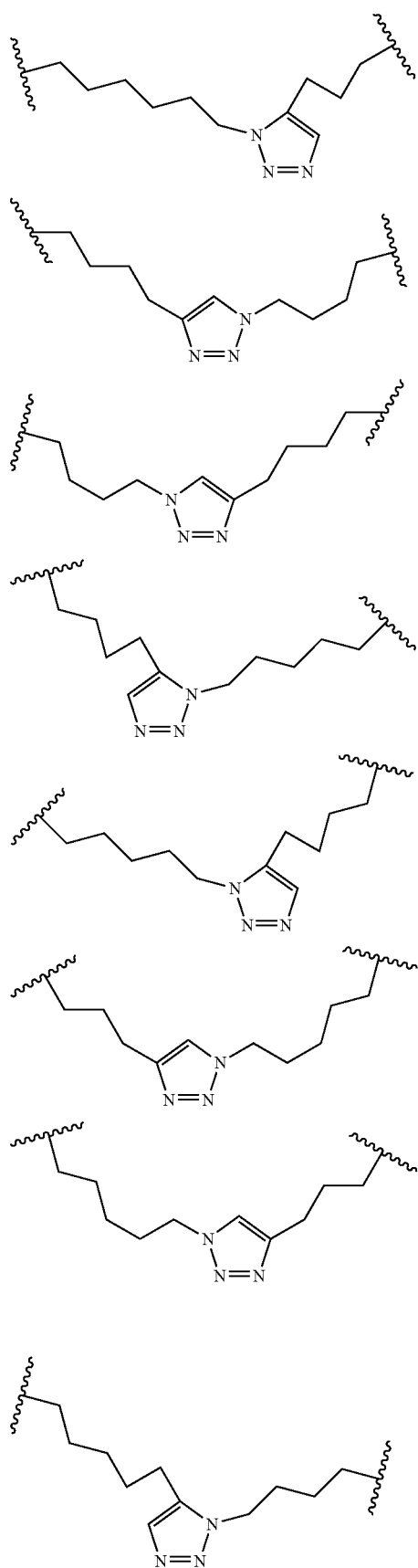
112
-continued
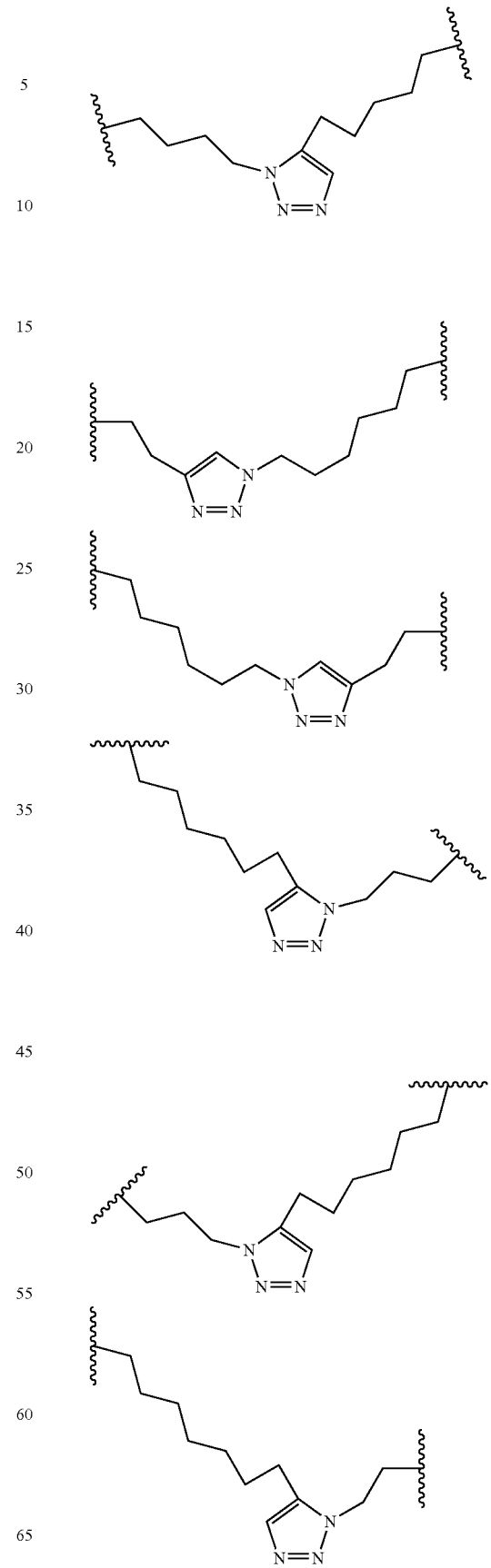

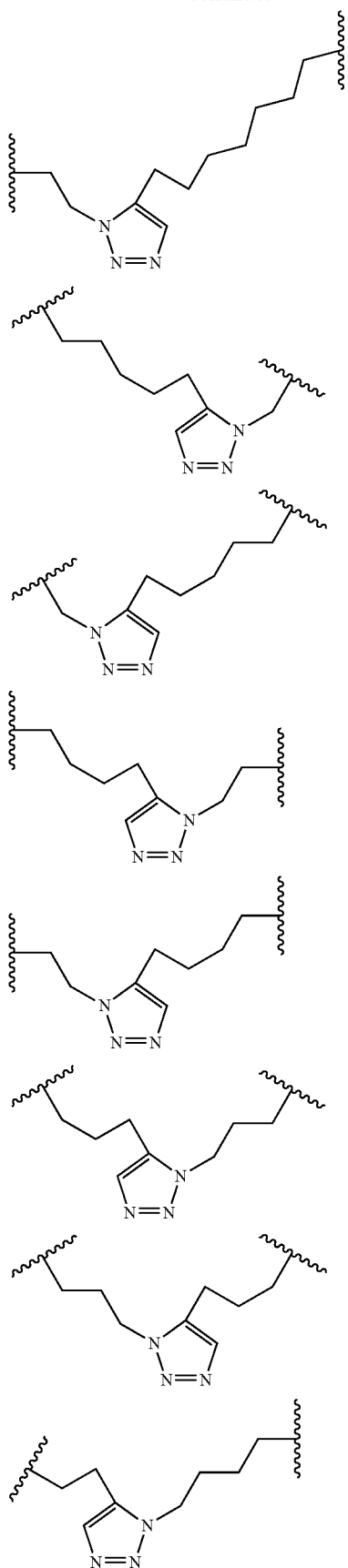
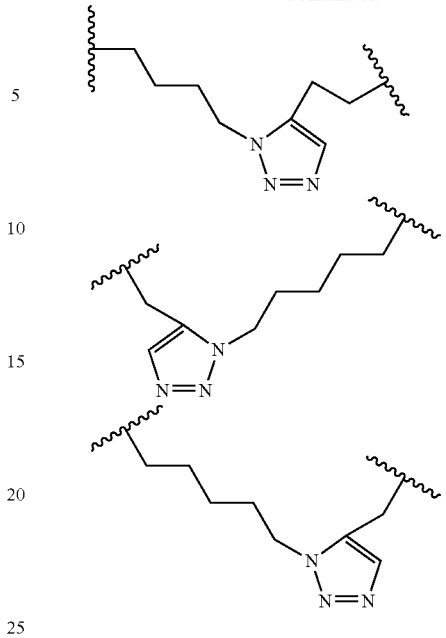

In some embodiments, the peptidomimetic macrocycle comprises an amino acid sequence of formula:

X1-X2-X3-X4-X5-X6-X7-X8-X9-X10-X11-X12-X13-X14-X15-X16-X17-X18-X19-X20-X21 wherein:

In some embodiments, X1 is Ile, Arg, Ala, Lys, Pro, Leu, Asp, Glu, His, Ser, Gln, Phe, an analog thereof, or absent.

In some embodiments, X2 is Trp, Arg, Ala, Asn, Phe, Pro, Leu, Ser, Lys, Tyr, His, Cou, Cou2, Cou4, Cou7, an analog thereof, a crosslinked amino acid, or absent.

In some embodiments, X3 is Ile, Ala, Leu, Phe, Tyr, Val, Asp, Trp, Pro, Gln, Chg, Ac5c, Ac6c, Tba, Bip, Cha, Adm, hCha, an analog thereof, or absent.

In some embodiments, X4 is Ala, Gln, Asp, Val, Gly, Ser, Leu, Phe, Cha, A4, an analog, thereof, a crosslinked amino acid, or absent.

In some embodiments, X5 is Gln, Ala, Leu, Phe, Tyr, Gly, Ile, Val, Arg, Glu, Pro, Asp, MO, MO2, an analog thereof, a crosslinked amino acid, or absent.

In some embodiments, X6 is Glu, Gln, His, Ala, Ser, Arg, Ile, Leu, Thr, Phe, Val, Tyr, Gly, Nle, St, an analog thereof, or absent.

In some embodiments, X7 is Ala, Leu, Phe, Ile, 2Nal, 1Nal, 3cf, Chg, Cha, Adm, hCha, Igl, Bip, an analog thereof, or absent.

In some embodiments, X8 is Arg, Ala, Asp, Glu, Thr, His, Gln, Gly, Asn, Phe, Cit, St, an analog thereof, a crosslinked amino acid, or absent.

In some embodiments, X9 is Arg, Ala, Asp, Lys, Asn, Gly, Ser, Gln, Cys, Nle, St, an analog thereof, or a crosslinked amino acid.

In some embodiments, X10 is Ile, Val, Ala, Asp, Asn, Phe, Tba, hL, hhL, Nle, Chg, Cha, an analog thereof, or a crosslinked amino acid.

In some embodiments, X11 is Gly, Val, Ala, Leu, Ile, Asp, Glu, Cha, Aib, Abu, an analog thereof, or a crosslinked amino acid.

In some embodiments, X12 is Asp, Ala, Asn, Gly, Arg, Glu, Lys, Leu, Nle, an analog thereof, or a crosslinked amino acid.

In some embodiments, X13 is Ala, Glu, Gln, Leu, Lys, Asp, Tyr, Ile, Ser, Cys, St, Sta5, Aib, Nle, an analog thereof, or a crosslinked amino acid.

In some embodiments, X14 is Phe, Ala, Leu, Val, Tyr, Glu, His, Ile, Nle, 1Nal, 2Nal, Chg, Cha, BiP, an analog thereof, or a crosslinked amino acid.

In some embodiments, X15 is Asn, Gln, Ser, His, Glu, Asp, Ala, Leu, Ile, St, Nle, Aib, an analog thereof, a crosslinked amino acid, or absent.

In some embodiments, X16 is Ala, Glu, Asp, Arg, Lys, Phe, Gly, Gln, Aib, Cha, St, an analog thereof, a crosslinked amino acid, or absent.

In some embodiments, X17 is Phe, Tyr, Ala, Leu, Asn, Ser, Gln, Arg, His, Thr, Cou2, Cou3, Cou7, Dpr, Amf, Damf, Amye, an analog thereof, a crosslinked amino acid, or absent.

In some embodiments, X18 is Tyr, Ala, Ile, Phe, His, Arg, Lys, Trp, Orn, Amf, Amye, Cha, 2Nal, an analog thereof, or absent.

In some embodiments, X19 is Ala, Lys, Arg, His, Ser, Gln, Glu, Asp, Thr, Aib, Cha, an analog thereof, a crosslinked amino acid, or absent.

In some embodiments, X20 is Arg, His, Ala, Thr, Lys, Amr, an analog thereof, a crosslinked amino acid, or absent.

In some embodiments, X21 is Arg, His, Ala, Amr, an analog thereof, or absent.

In some embodiments, the peptidomimetic macrocycle comprises a helix.

In some embodiments, the peptidomimetic macrocycle comprises an α-helix.

In some embodiments, the peptidomimetic macrocycle comprises an α,α-disubstituted amino acid.

In some embodiments, each amino acid connected by the macrocycle-forming linker is an α,α-disubstituted amino acid.

Preparation of Peptidomimetic Macrocycles

Peptidomimetic macrocycles of the invention may be prepared by any of a variety of methods known in the art. For example, any of the residues indicated by "X", "Z" or "XX" in Tables 1 or 2 may be substituted with a residue capable of forming a crosslinker with a second residue in the same molecule or a precursor of such a residue.

Various methods to effect formation of peptidomimetic macrocycles are known in the art. For example, the preparation of peptidomimetic macrocycles of Formula I is described in Schafmeister et al., J. Am. Chem. Soc. 122: 5891-5892 (2000); Schafmeister & Verdine, J. Am. Chem. Soc. 122:5891 (2005); Walensky et al., Science 305:1466-1470 (2004); U.S. Pat. No. 7,192,713 and PCT application WO 2008/121767. The α,α-disubstituted amino acids and amino acid precursors disclosed in the cited references may be employed in synthesis of the peptidomimetic macrocycle precursor polypeptides. For example, the "S5-olefin amino acid" is (S)-α-(2'-pentenyl) alanine and the "R8 olefin amino acid" is (R)-α-(2'-octenyl) alanine. Following incorporation of such amino acids into precursor polypeptides, the terminal olefins are reacted with a metathesis catalyst, leading to the formation of the peptidomimetic macrocycle. In various embodiments, the following amino acids may be employed in the synthesis of the peptidomimetic macrocycle:

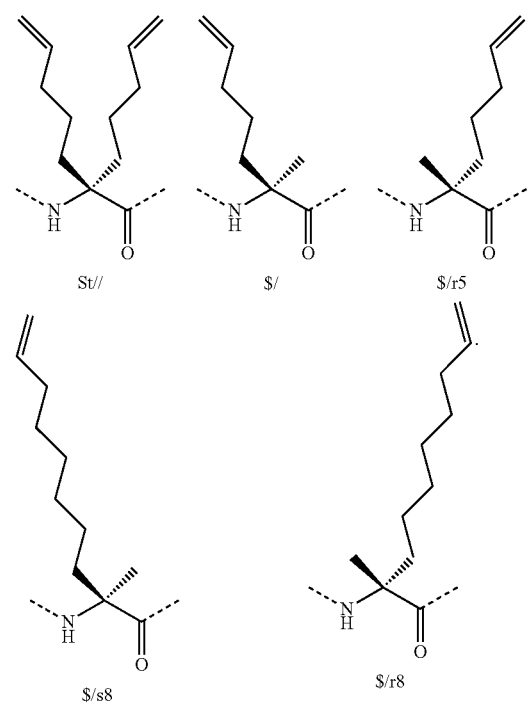

In some embodiments, x+y+z is 3, and A, B and C are independently natural or non-natural amino acids. In other embodiments, x+y+z is 6, and A, B and C are independently natural or non-natural amino acids.

In some embodiments, the contacting step is performed in a solvent selected from the group consisting of protic solvent, aqueous solvent, organic solvent, and mixtures thereof. For example, the solvent may be chosen from the group consisting of H$_2$O, THF, THF/H$_2$O, tBuOH/H$_2$O, DMF, DIPEA, CH$_3$CN or CH$_2$Cl$_2$, ClCH$_2$CH$_2$Cl or a mixture thereof. The solvent may be a solvent which favors helix formation.

Alternative but equivalent protecting groups, leaving groups or reagents are substituted, and certain of the synthetic steps are performed in alternative sequences or orders to produce the desired compounds. Synthetic chemistry transformations and protecting group methodologies (protection and deprotection) useful in synthesizing the compounds described herein include, for example, those such as described in Larock, *Comprehensive Organic Transformations*, VCH Publishers (1989); Greene and Wuts, *Protective Groups in Organic Synthesis,* 2d. Ed., John Wiley and Sons (1991); Fieser and Fieser, *Fieser and Fieser's Reagents for Organic Synthesis*, John Wiley and Sons (1994); and Paquette, ed., *Encyclopedia of Reagents for Organic Synthesis*, John Wiley and Sons (1995), and subsequent editions thereof.

The peptidomimetic macrocycles disclosed herein are made, for example, by chemical synthesis methods, such as described in Fields et al., Chapter 3 in *Synthetic Peptides: A User's Guide*, ed. Grant, W. H. Freeman & Co., New York, N.Y., 1992, p. 77. Hence, for example, peptides are synthesized using the automated Merrifield techniques of solid phase synthesis with the amine protected by either tBoc or Fmoc chemistry using side chain protected amino acids on, for example, an automated peptide synthesizer (e.g., Applied Biosystems (Foster City, Calif.), Model 430A, 431, or 433).

One manner of producing the peptidomimetic precursors and peptidomimetic macrocycles described herein uses solid phase peptide synthesis (SPPS). The C-terminal amino acid is attached to a cross-linked polystyrene resin via an acid labile bond with a linker molecule. This resin is insoluble in the solvents used for synthesis, making it relatively simple and fast to wash away excess reagents and by-products. The N-terminus is protected with the Fmoc group, which is stable in acid, but removable by base. Side chain functional groups are protected as necessary with base stable, acid labile groups.

Longer peptidomimetic precursors are produced, for example, by conjoining individual synthetic peptides using native chemical ligation. Alternatively, the longer synthetic peptides are biosynthesized by well known recombinant DNA and protein expression techniques. Such techniques are provided in well-known standard manuals with detailed protocols. To construct a gene encoding a peptidomimetic precursor of this invention, the amino acid sequence is reverse translated to obtain a nucleic acid sequence encoding the amino acid sequence, preferably with codons that are optimum for the organism in which the gene is to be expressed. Next, a synthetic gene is made, typically by synthesizing oligonucleotides which encode the peptide and any regulatory elements, if necessary. The synthetic gene is inserted in a suitable cloning vector and transfected into a host cell. The peptide is then expressed under suitable conditions appropriate for the selected expression system and host. The peptide is purified and characterized by standard methods.

The peptidomimetic precursors are made, for example, in a high-throughput, combinatorial fashion using, for example, a high-throughput polychannel combinatorial synthesizer (e.g., Thuramed TETRAS multichannel peptide synthesizer from CreoSalus, Louisville, Ky. or Model Apex 396 multichannel peptide synthesizer from AAPPTEC, Inc., Louisville, Ky.).

In some embodiments, the peptidomimetic macrocycles of the invention comprise triazole macrocycle-forming linkers. For example, the synthesis of such peptidomimetic macrocycles involves a multi-step process that features the synthesis of a peptidomimetic precursor containing an azide moiety and an alkyne moiety; followed by contacting the peptidomimetic precursor with a macrocyclization reagent to generate a triazole-linked peptidomimetic macrocycle. Such a process is described, for example, in U.S. application Ser. No. 12/037,041, filed on Feb. 25, 2008. Macrocycles or macrocycle precursors are synthesized, for example, by solution phase or solid-phase methods, and can contain both naturally-occurring and non-naturally-occurring amino acids. See, for example, Hunt, "The Non-Protein Amino Acids" in *Chemistry and Biochemistry of the Amino Acids*, edited by G. C. Barrett, Chapman and Hall, 1985.

In some embodiments, an azide is linked to the α-carbon of a residue and an alkyne is attached to the α-carbon of another residue. In some embodiments, the azide moieties are azido-analogs of amino acids L-lysine, D-lysine, alpha-methyl-L-lysine, alpha-methyl-D-lysine, L-ornithine, D-ornithine, alpha-methyl-L-ornithine or alpha-methyl-D-ornithine. In another embodiment, the alkyne moiety is L-propargylglycine. In yet other embodiments, the alkyne moiety is an amino acid selected from the group consisting of L-propargylglycine, D-propargylglycine, (S)-2-amino-2-methyl-4-pentynoic acid, (R)-2-amino-2-methyl-4-pentynoic acid, (S)-2-amino-2-methyl-5-hexynoic acid, (R)-2-amino-2-methyl-5-hexynoic acid, (S)-2-amino-2-methyl-6-heptynoic acid, (R)-2-amino-2-methyl-6-heptynoic acid, (S)-2-amino-2-methyl-7-octynoic acid, (R)-2-amino-2-methyl-7-octynoic acid, (S)-2-amino-2-methyl-8-nonynoic acid and (R)-2-amino-2-methyl-8-nonynoic acid.

The following synthetic schemes are provided solely to illustrate the present invention and are not intended to limit the scope of the invention, as described herein. To simplify the drawings, the illustrative schemes depict azido amino acid analogs ε-azido-α-methyl-L-lysine and ε-azido-α-methyl-D-lysine, and alkyne amino acid analogs L-propargylglycine, (S)-2-amino-2-methyl-4-pentynoic acid, and (S)-2-amino-2-methyl-6-heptynoic acid. Thus, in the following synthetic schemes, each $R_1$, $R_2$, $R_7$ and $R_8$ is —H; each $L_1$ is —$(CH_2)_4$—; and each $L_2$ is —$(CH_2)$—. However, as noted throughout the detailed description above, many other amino acid analogs can be employed in which $R_1$, $R_2$, $R_7$, $R_8$, $L_1$ and $L_2$ can be independently selected from the various structures disclosed herein.

Synthetic Scheme 1:

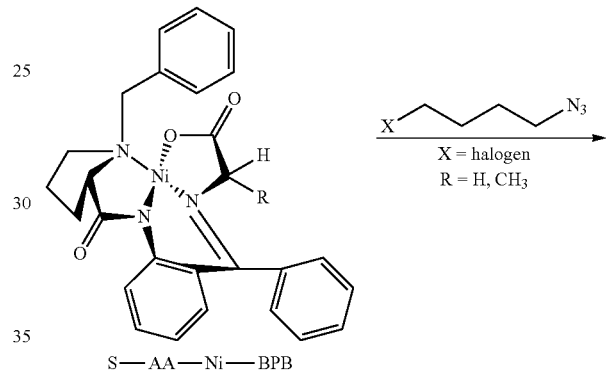

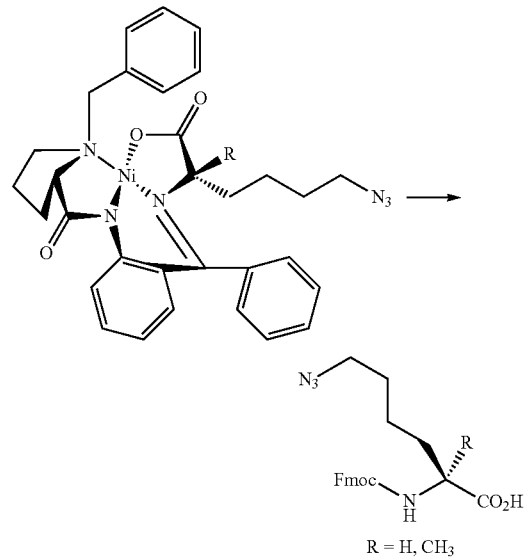

119
-continued

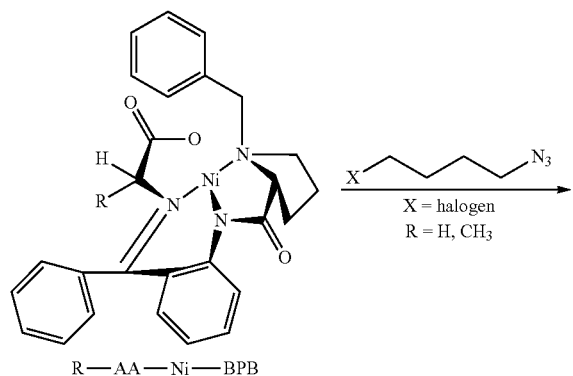

R—AA—Ni—BPB

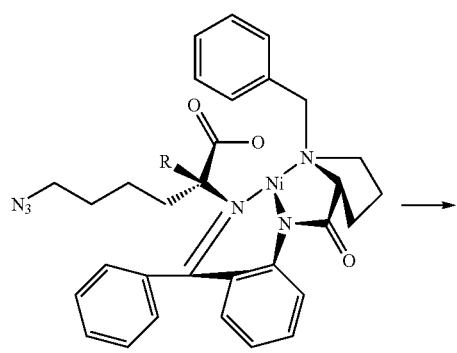

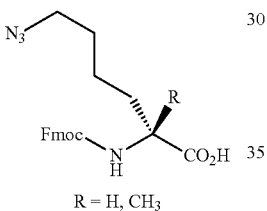

R = H, CH₃

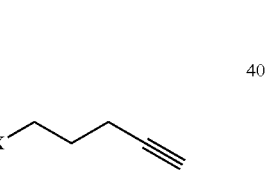

S—AA—Ni—BPB

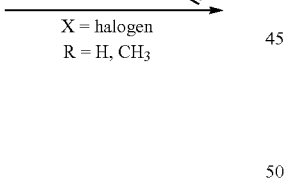

120
-continued

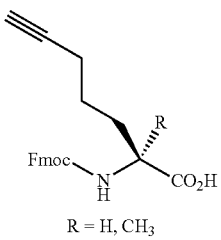

R = H, CH₃

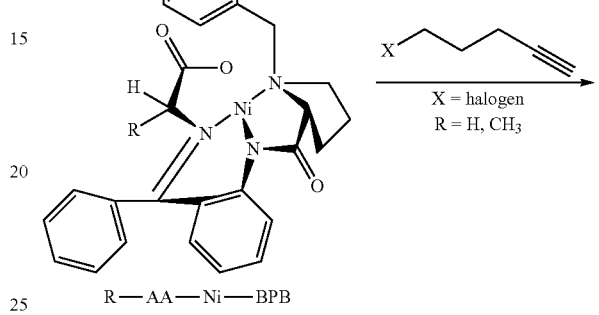

R—AA—Ni—BPB

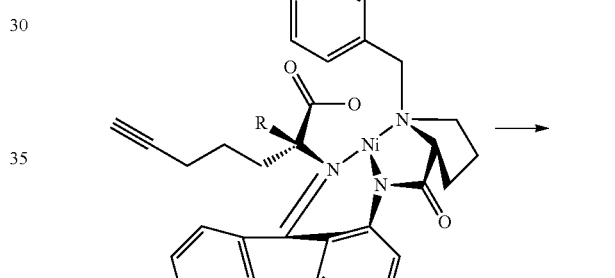

R = H, CH₃

Synthetic Scheme 1 describes the preparation of several compounds of the invention. Ni(II) complexes of Schiff bases derived from the chiral auxiliary (S)-2-[N—(N'-benzylprolyl)amino]benzophenone (BPB) and amino acids such as glycine or alanine are prepared as described in Belokon et al. (1998), *Tetrahedron Asymm.* 9:4249-4252. The resulting complexes are subsequently reacted with alkylating reagents comprising an azido or alkynyl moiety to yield enantiomerically enriched compounds of the invention. If desired, the resulting compounds can be protected for use in peptide synthesis.

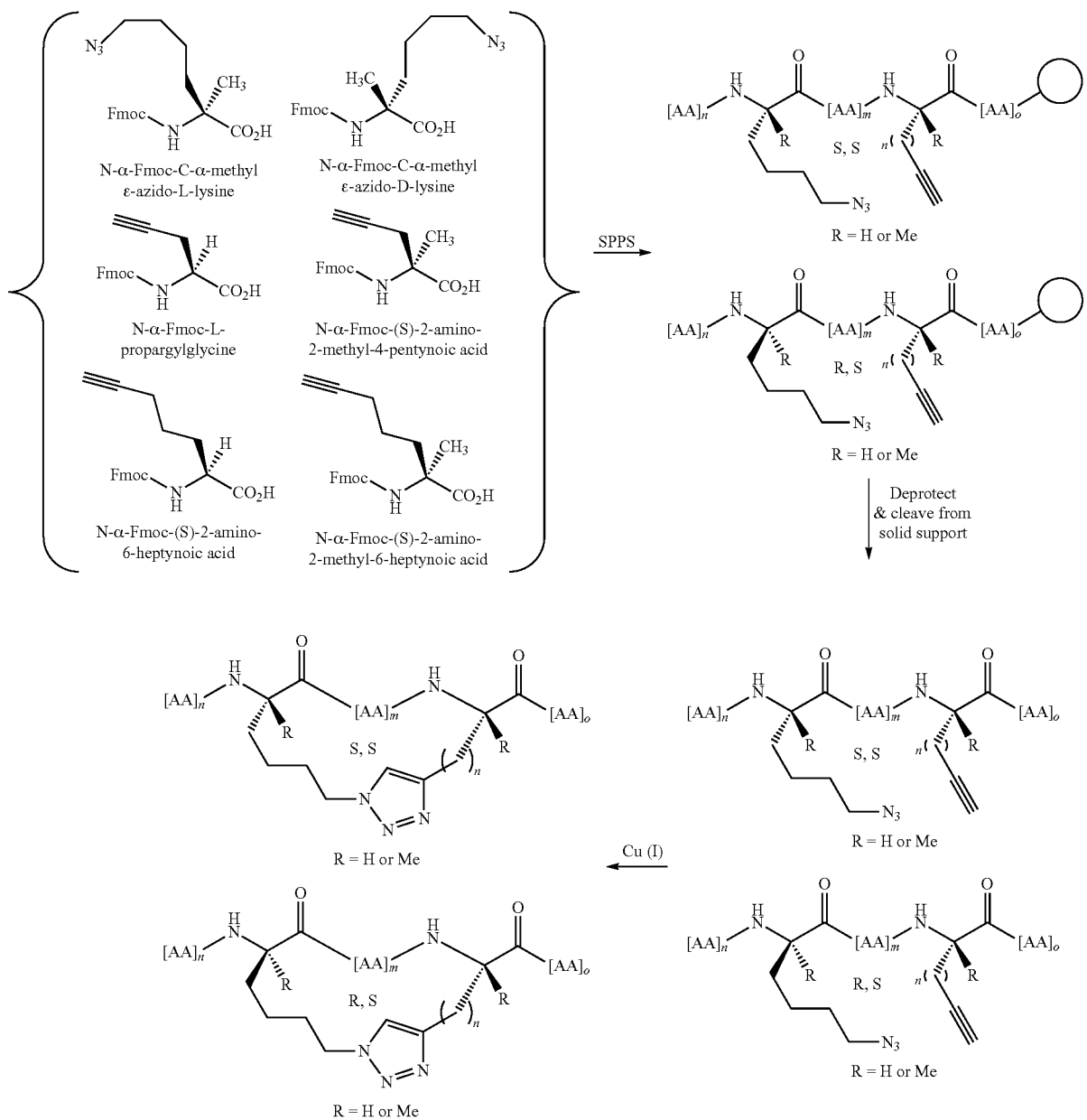

Synthetic Scheme 2:

In the general method for the synthesis of peptidomimetic macrocycles shown in Synthetic Scheme 2, the peptidomimetic precursor contains an azide moiety and an alkyne moiety and is synthesized by solution-phase or solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is then deprotected and cleaved from the solid-phase resin by standard conditions (e.g., strong acid such as 95% TFA). The peptidomimetic precursor is reacted as a crude mixture or is purified prior to reaction with a macrocyclization reagent such as a Cu(I) in organic or aqueous solutions (Rostovtsev et al. (2002), Angew. Chem. Int. Ed 41:2596-2599; Tornoe et al. (2002), J. Org. Chem. 67:3057-3064; Deiters et al. (2003), J. Am. Chem. Soc. 125:11782-11783; Punna et al. (2005), Angew. Chem. Int. Ed. 44:2215-2220). In one embodiment, the triazole forming reaction is performed under conditions that favor α-helix formation. In one embodiment, the macrocyclization step is performed in a solvent chosen from the group consisting of $H_2O$, THF, $CH_3CN$, DMF, DIPEA, tBuOH or a mixture thereof. In another embodiment, the macrocyclization step is performed in DMF. In some embodiments, the macrocyclization step is performed in a buffered aqueous or partially aqueous solvent.

Synthetic Scheme 3:

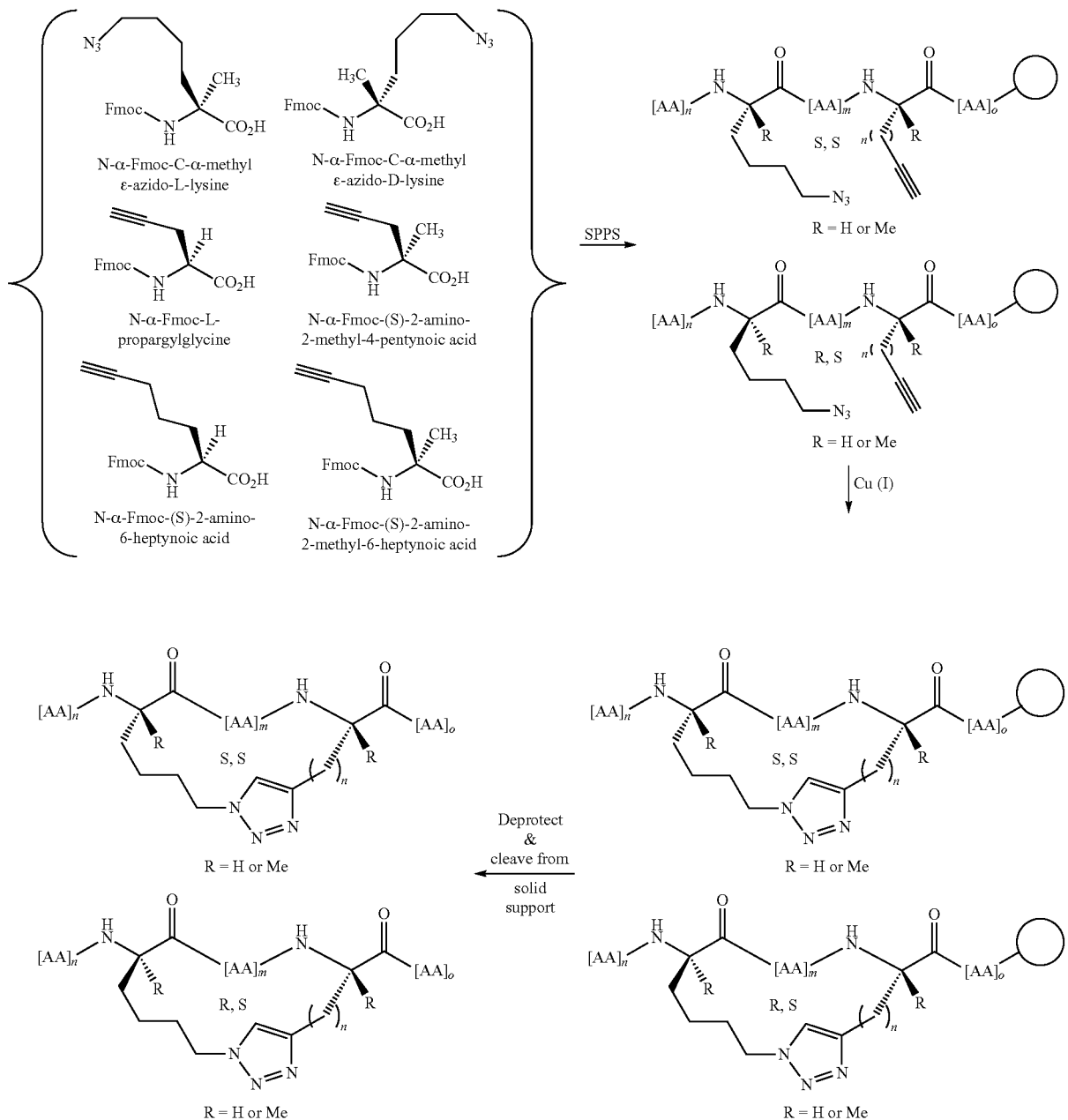

In the general method for the synthesis of peptidomimetic macrocycles shown in Synthetic Scheme 3, the peptidomimetic precursor contains an azide moiety and an alkyne moiety and is synthesized by solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is reacted with a macrocyclization reagent such as a Cu(I) reagent on the resin as a crude mixture (Rostovtsev et al. (2002), *Angew. Chem. Int. Ed.* 41:2596-2599; Tornoe et al. (2002), *J. Org. Chem.* 67:3057-3064; Deiters et al. (2003), *J. Am. Chem. Soc.* 125:11782-11783; Punna et al. (2005), *Angew. Chem. Int. Ed.* 44:2215-2220). The resultant triazole-containing peptidomimetic macrocycle is then deprotected and cleaved from the solid-phase resin by standard conditions (e.g., strong acid such as 95% TFA). In some embodiments, the macrocyclization step is performed in a solvent chosen from the group consisting of $CH_2Cl_2$, $ClCH_2CH_2Cl$, DMF, THF, NMP, DIPEA, 2,6-lutidine, pyridine, DMSO, $H_2O$ or a mixture thereof. In some embodiments, the macrocyclization step is performed in a buffered aqueous or partially aqueous solvent.

Synthetic Scheme 4:

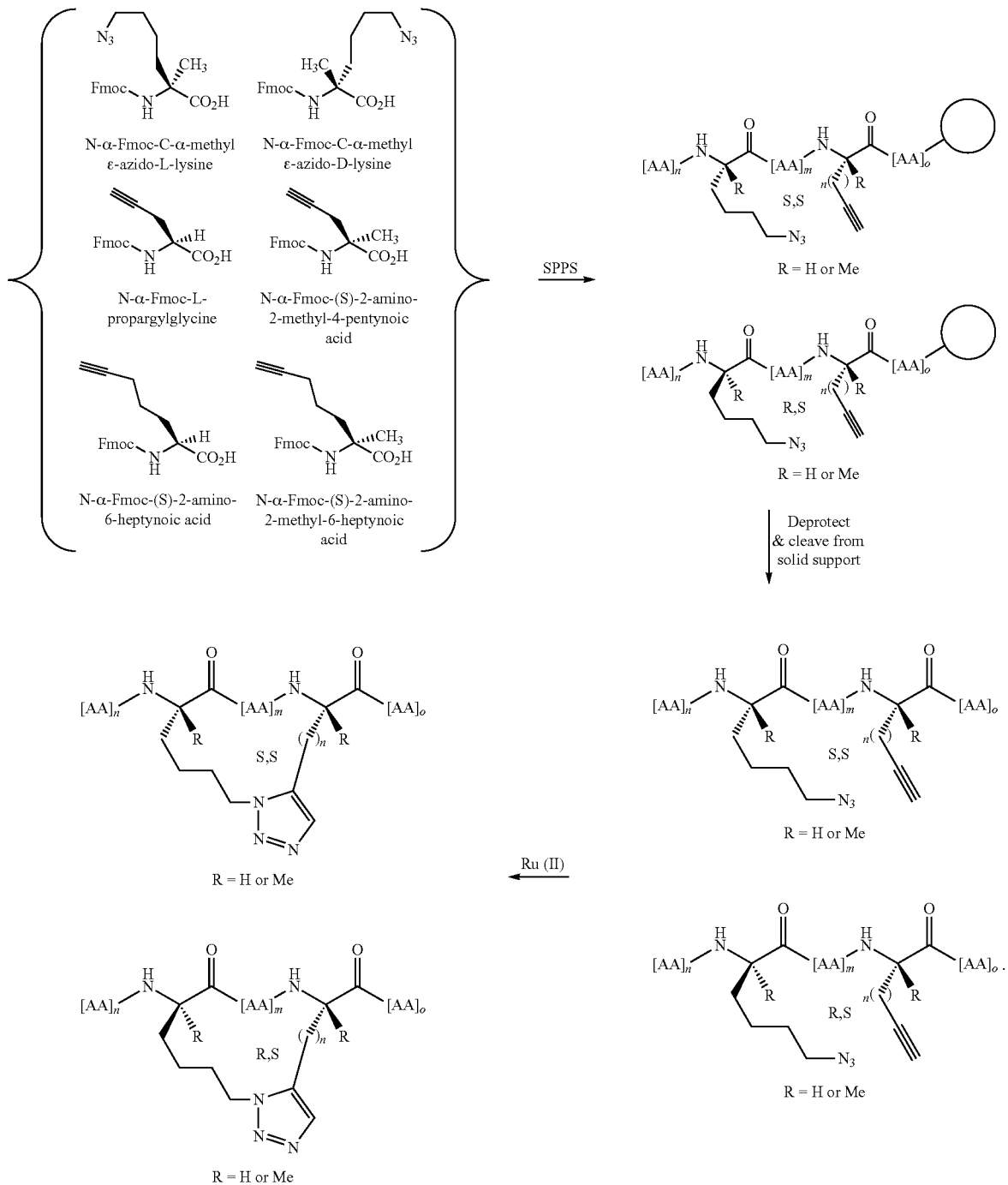

In the general method for the synthesis of peptidomimetic macrocycles shown in Synthetic Scheme 4, the peptidomimetic precursor contains an azide moiety and an alkyne moiety and is synthesized by solution-phase or solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is then deprotected and cleaved from the solid-phase resin by standard conditions (e.g., strong acid such as 95% TFA). The peptidomimetic precursor is reacted as a crude mixture or is purified prior to reaction with a macrocyclization reagent such as a Ru(II) reagents, for example Cp*RuCl(PPh$_3$)$_2$ or [Cp*RuCl]$_4$ (Rasmussen et al. (2007), Org. Lett. 9:5337-5339; Zhang et al. (2005), J. Am. Chem. Soc. 127:15998-15999). In some embodiments, the macrocyclization step is performed in a solvent chosen from the group consisting of DMF, CH$_3$CN and THF.

Synthetic Scheme 5:

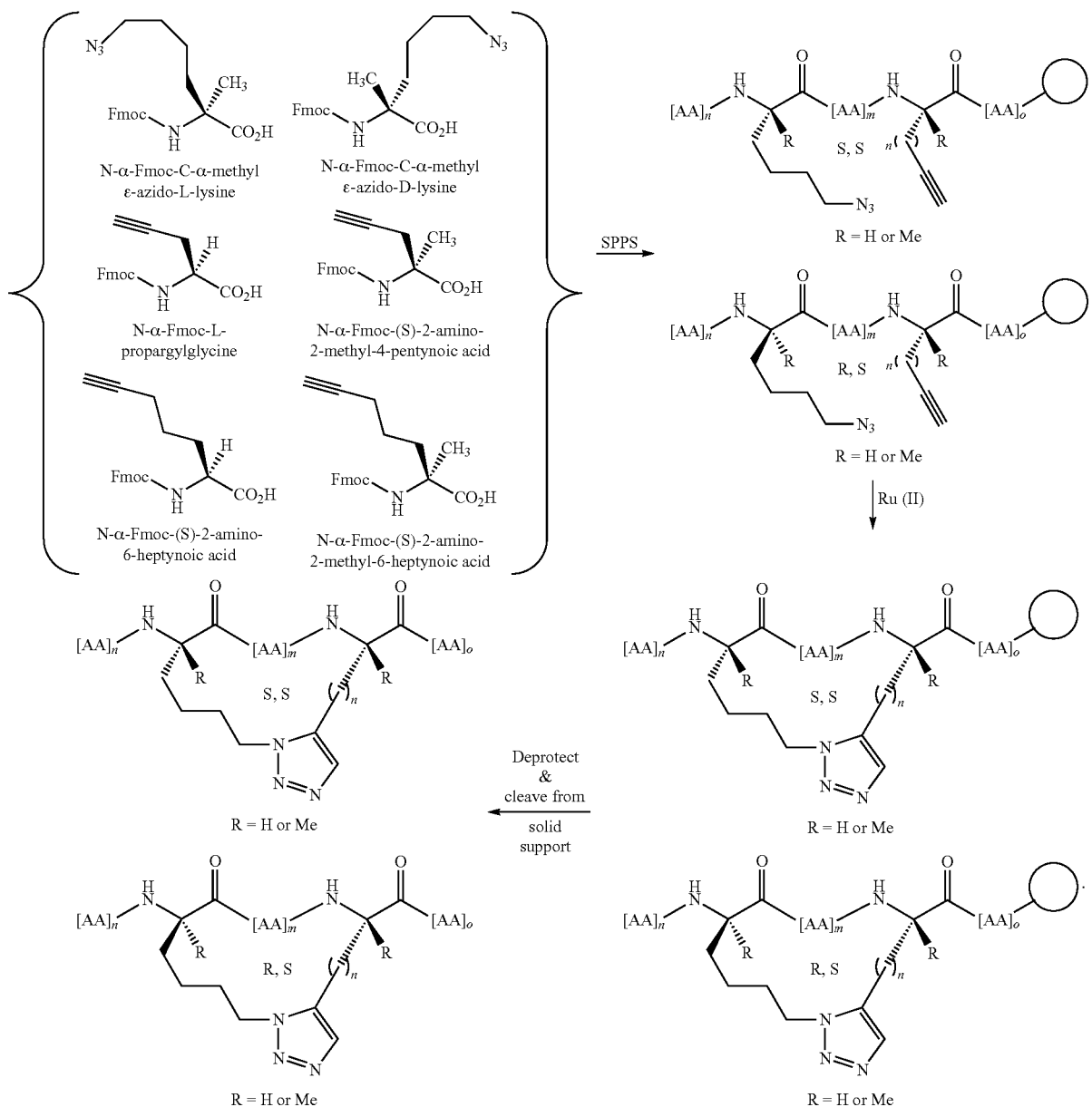

In the general method for the synthesis of peptidomimetic macrocycles shown in Synthetic Scheme 5, the peptidomimetic precursor contains an azide moiety and an alkyne moiety and is synthesized by solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is reacted with a macrocyclization reagent such as a Ru(II) reagent on the resin as a crude mixture. For example, the reagent can be Cp*RuCl(PPh$_3$)$_2$ or [Cp*RuCl]$_4$ (Rasmussen et al. (2007), Org. Lett. 9:5337-5339; Zhang et al. (2005), J. Am. Chem. Soc. 127:15998-15999). In some embodiments, the macrocyclization step is performed in a solvent chosen from the group consisting of CH$_2$Cl$_2$, ClCH$_2$CH$_2$Cl, CH$_3$CN, DMF, and THF.

In some embodiments, a peptidomimetic macrocycle of Formula I comprises a halogen group substitution on a triazole moiety, for example an iodo substitution. Such peptidomimetic macrocycles may be prepared from a precursor having the partial structure and using the cross-linking methods taught herein. Crosslinkers of any length, as described herein, may be prepared comprising such substitutions. In one embodiment, the peptidomimetic macrocycle is prepared according to the scheme shown below. The reaction is performed, for example, in the presence of CuI and an amine ligand such as TEA or TITA. See, e.g., Hein et al. Angew. Chem., Int. Ed. 2009, 48, 8018-8021.

129

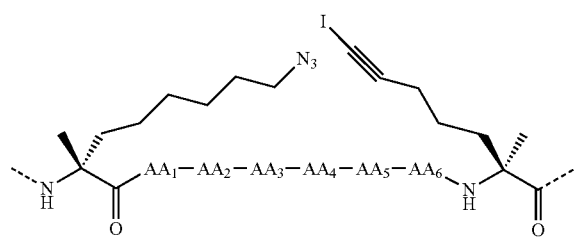

130

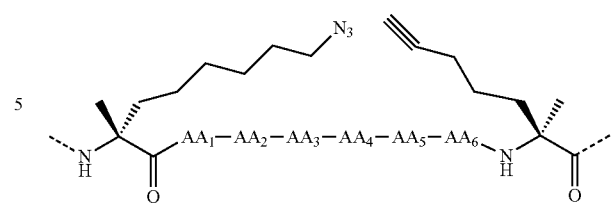

In other embodiments, an iodo-substituted triazole is generated according to the scheme shown below. For example, the second step in the reaction scheme below is performed using, for example, CuI and N-bromosuccinimide (NBS) in the presence of THF (see, e.g. Zhang et al., J. Org. Chem. 2008, 73, 3630-3633). In other embodiments, the second step in the reaction scheme shown below is performed, for example, using CuI and an iodinating agent such as ICl (see, e.g. Wu et al., Synthesis 2005, 1314-1318.)

In some embodiments, an iodo-substituted triazole moiety is used in a cross-coupling reaction, such as a Suzuki or Sonogashira coupling, to afford a peptidomimetic macrocycle comprising a substituted crosslinker. Sonogashira couplings using an alkyne as shown below may be performed, for example, in the presence of a palladium catalyst such as Pd(PPh$_3$)$_2$Cl$_2$, CuI, and in the presence of a base such as triethylamine. Suzuki couplings using an arylboronic or substituted alkenyl boronic acid as shown below may be performed, for example, in the presence of a catalyst such as Pd(PPh$_3$)$_4$, and in the presence of a base such as K$_2$CO$_3$.

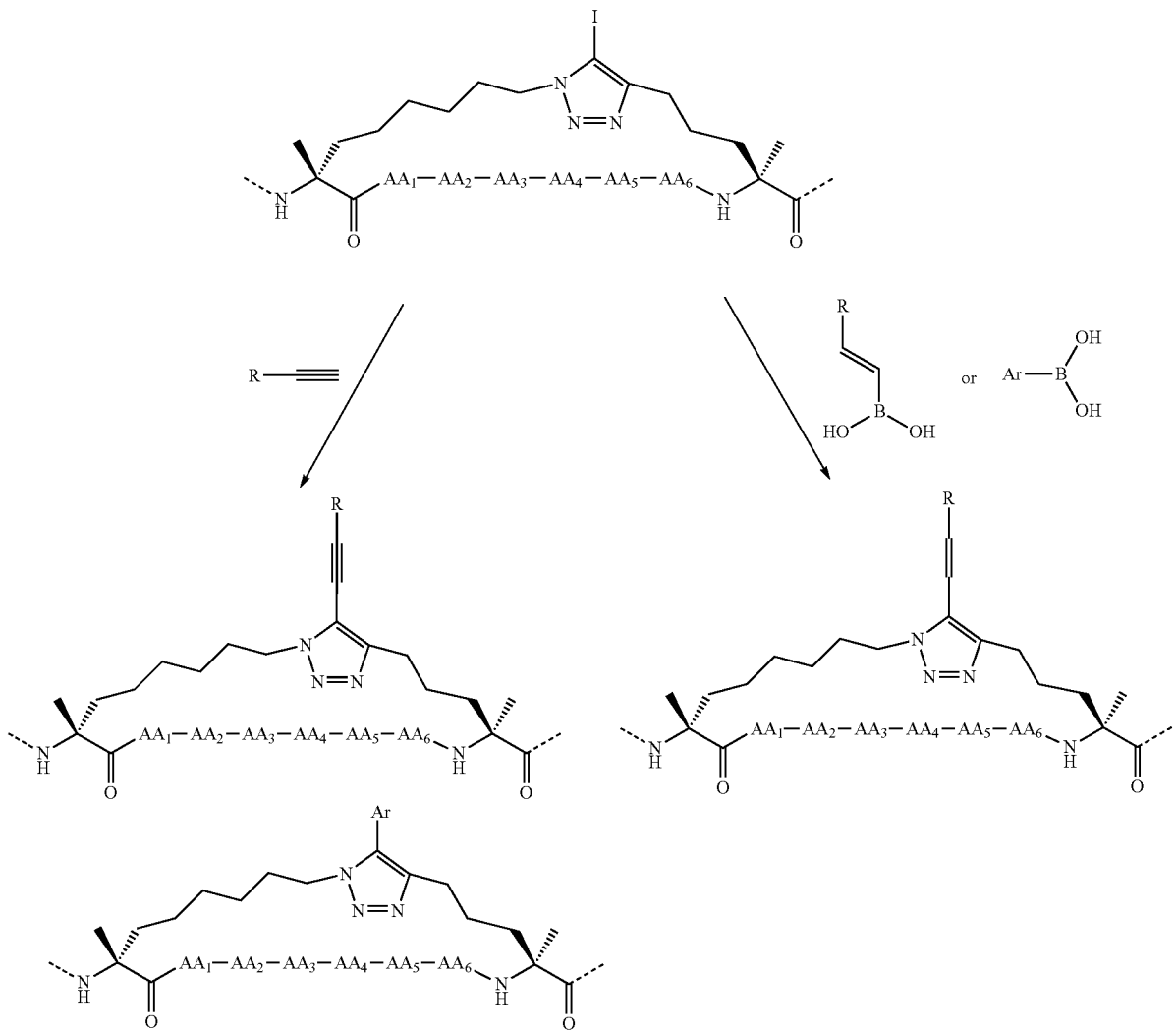

Any suitable triazole substituent groups which reacts with the iodo-substituted triazole can be used in Suzuki couplings described herein. Example triazole substituents for use in Suzuki couplings are shown below:

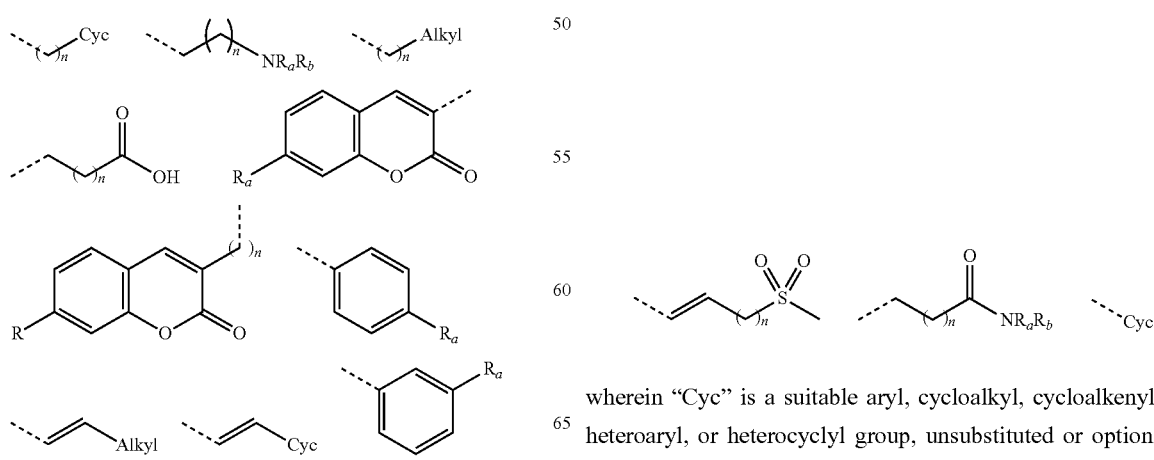

wherein "Cyc" is a suitable aryl, cycloalkyl, cycloalkenyl, heteroaryl, or heterocyclyl group, unsubstituted or optionally substituted with an $R_a$ or $R_b$ group as described below.

In some embodiments, the substituent is:

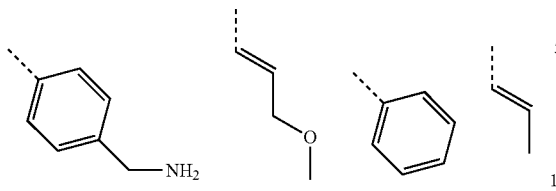

Any suitable substituent group which reacts with the iodo-substituted triazole can be used in Sonogashira couplings described herein. Example triazole substituents for use in Sonogashira couplings are shown below:

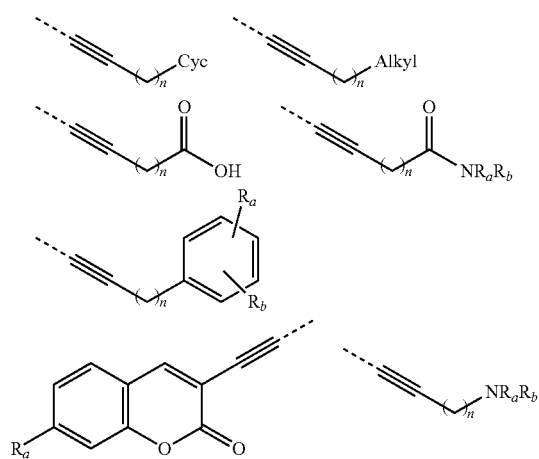

wherein "Cyc" is a suitable aryl, cycloalkyl, cycloalkenyl, heteroaryl, or heterocyclyl group, unsubstituted or optionally substituted with an $R_a$ or $R_b$ group as described below.

In some embodiments, the triazole substituent is:

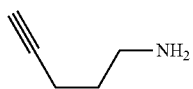

In some embodiments, the Cyc group shown above is further substituted by at least one $R_a$ or $R_b$ substituent. In some embodiments, at least one of $R_a$ and $R_b$ is independently:

$R_a$ or $R_b$=H, $OCH_3$, $CF_3$, $NH_2$, $CH_2NH_2$, F, Br, I

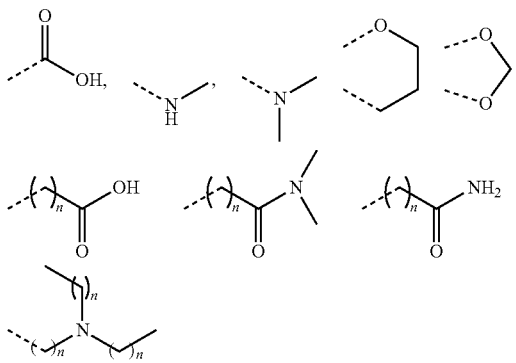

In other embodiments, the triazole substituent is

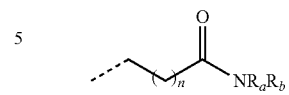

and at least one of $R_a$ and $R_b$ is alkyl (including hydrogen, methyl, or ethyl), or:

The present invention contemplates the use of non-naturally-occurring amino acids and The present invention contemplates the use of non-naturally-occurring amino acids and amino acid analogs in the synthesis of the peptidomimetic macrocycles described herein. Any amino acid or amino acid analog amenable to the synthetic methods employed for the synthesis of stable triazole containing peptidomimetic macrocycles can be used in the present invention. For example, L-propargylglycine is contemplated as a useful amino acid in the present invention. However, other alkyne-containing amino acids that contain a different amino acid side chain are also useful in the invention. For example, L-propargylglycine contains one methylene unit between the α-carbon of the amino acid and the alkyne of the amino acid side chain. The invention also contemplates the use of amino acids with multiple methylene units between the α-carbon and the alkyne. Also, the azido-analogs of amino acids L-lysine, D-lysine, alpha-methyl-L-lysine, and alpha-methyl-D-lysine are contemplated as useful amino acids in the present invention. However, other terminal azide amino acids that contain a different amino acid side chain are also useful in the invention. For example, the azido-analog of L-lysine contains four methylene units between the α-carbon of the amino acid and the terminal azide of the amino acid side chain. The invention also contemplates the use of amino acids with fewer than or greater than four methylene units between the α-carbon and the terminal azide. Table 2 shows some amino acids useful in the preparation of peptidomimetic macrocycles disclosed herein.

TABLE 2

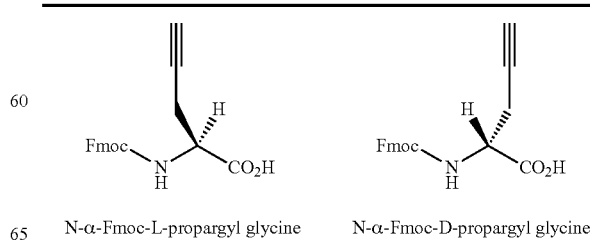

N-α-Fmoc-L-propargyl glycine     N-α-Fmoc-D-propargyl glycine

TABLE 2-continued

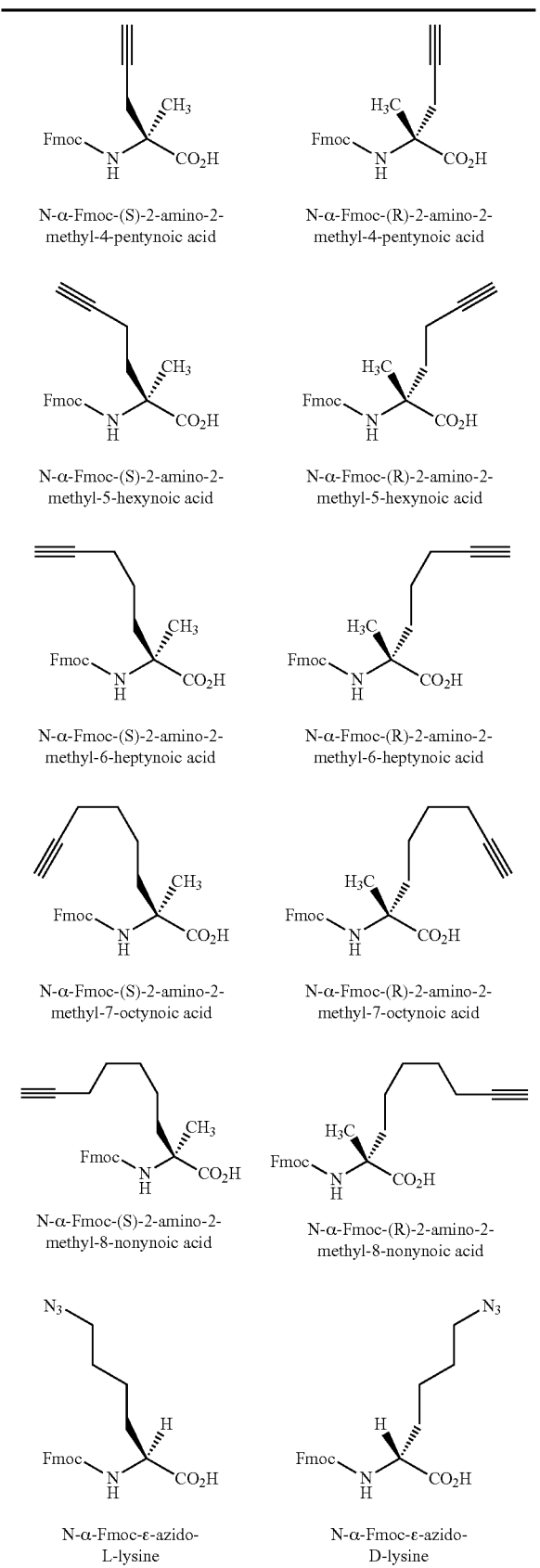

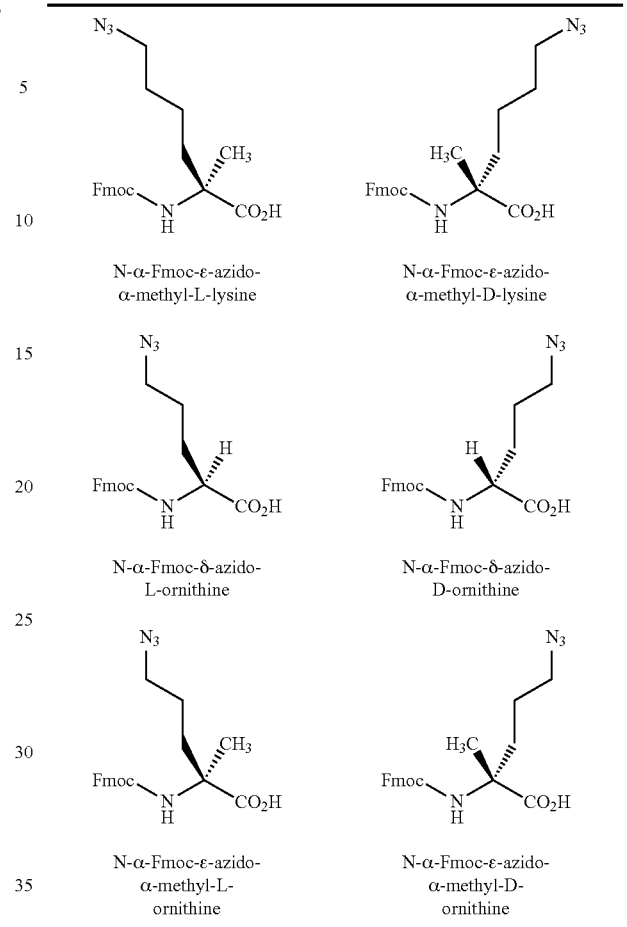

In some embodiments the amino acids and amino acid analogs are of the D-configuration. In other embodiments they are of the L-configuration. In some embodiments, some of the amino acids and amino acid analogs contained in the peptidomimetic are of the D-configuration while some of the amino acids and amino acid analogs are of the L-configuration. In some embodiments the amino acid analogs are α,α-disubstituted, such as α-methyl-L-propargylglycine, α-methyl-D-propargylglycine, ε-azido-alpha-methyl-L-lysine, and ε-azido-alpha-methyl-D-lysine. In some embodiments the amino acid analogs are N-alkylated, e.g., N-methyl-L-propargylglycine, N-methyl-D-propargylglycine, N-methyl-ε-azido-L-lysine, and N-methyl-ε-azido-D-lysine.

In some embodiments, the —NH moiety of the amino acid is protected using a protecting group, including without limitation -Fmoc and -Boc. In other embodiments, the amino acid is not protected prior to synthesis of the peptidomimetic macrocycle.

In some embodiments, the —NH moiety of the amino acid is protected using a protecting group, including without limitation -Fmoc and -Boc. In other embodiments, the amino acid is not protected prior to synthesis of the peptidomimetic macrocycle.

The preparation of macrocycles of Formula IV is described, for example, in U.S. application Ser. No. 11/957, 325, filed on Dec. 17, 2007 and herein incorporated by reference. Synthetic Schemes 6-9 describe the preparation of such compounds of Formula IV. To simplify the drawings, the illustrative schemes depict amino acid analogs derived from L- or D-cysteine, in which $L_1$ and $L_3$ are both —$(CH_2)$—. However, as noted throughout the detailed description above, many other amino acid analogs can be employed in which $L_1$ and $L_3$ can be independently selected from the various structures disclosed herein. The symbols "$[AA]_m$", "$[AA]_n$", "$[AA]_o$" represent a sequence of amide bond-linked moieties such as natural or unnatural amino acids. As described previously, each occurrence of "AA" is independent of any other occurrence of "AA", and a formula such as "$[AA]_m$" encompasses, for example, sequences of non-identical amino acids as well as sequences of identical amino acids.

Synthetic Scheme 6:

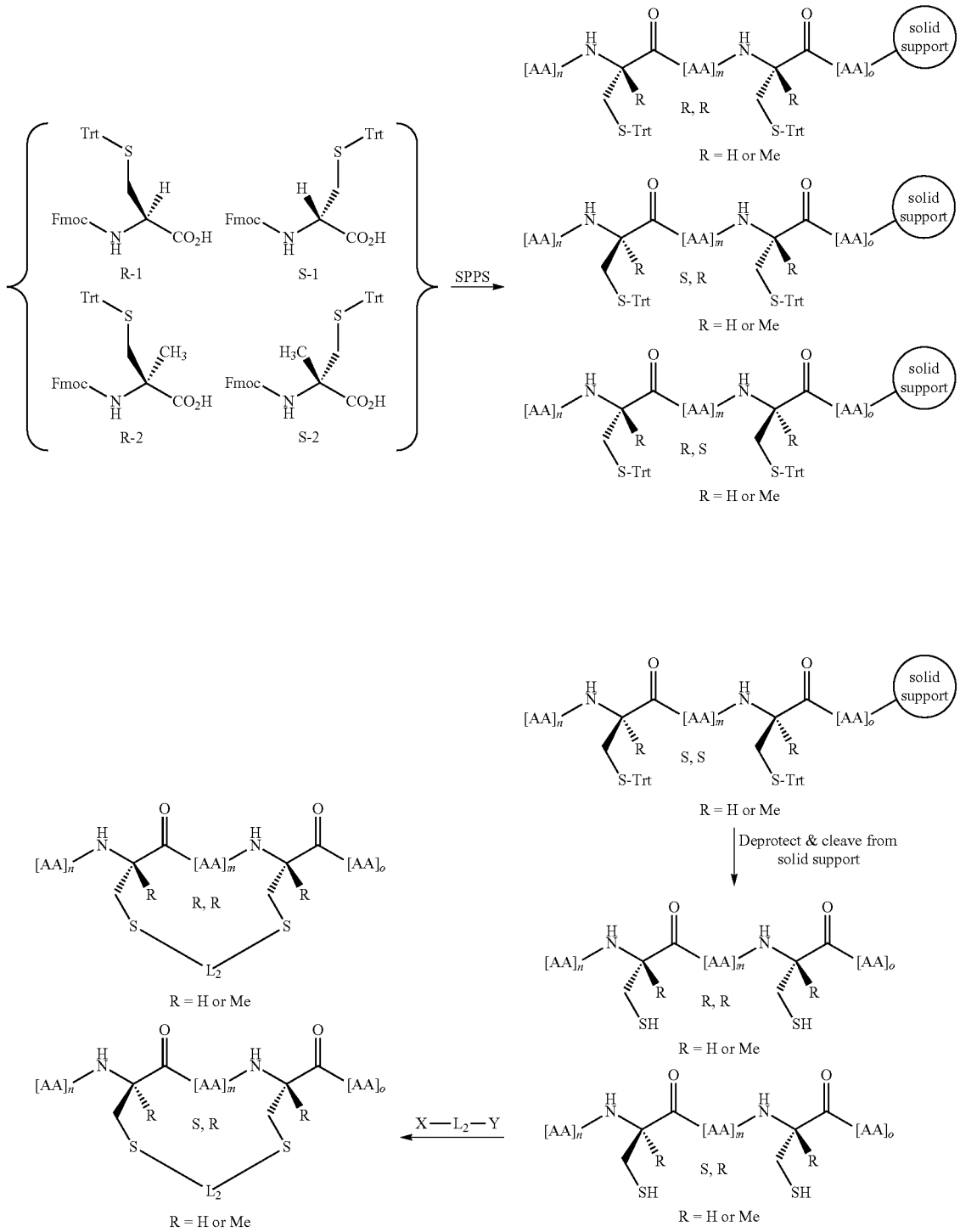

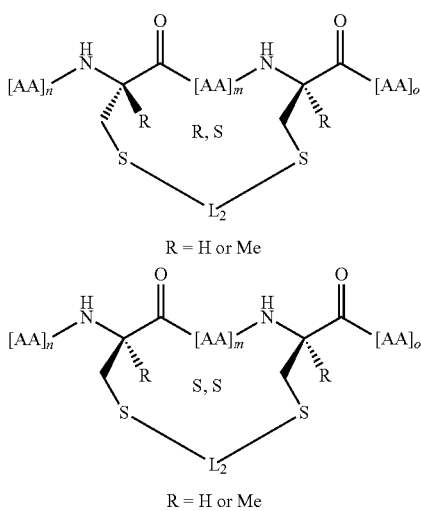

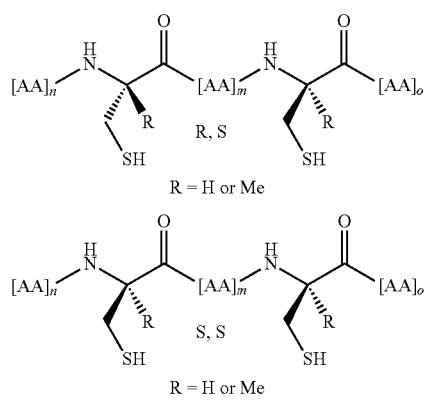

In Scheme 6, the peptidomimetic precursor contains two —SH moieties and is synthesized by solid-phase peptide synthesis (SPPS) using commercially available N-α-Fmoc amino acids such as N-α-Fmoc-S-trityl-L-cysteine or N-α-Fmoc-S-trityl-D-cysteine. Alpha-methylated versions of D-cysteine or L-cysteine are generated by known methods (Seebach et al. (1996), *Angew. Chem. Int. Ed. Engl.* 35:2708-2748, and references therein) and then converted to the appropriately protected N-α-Fmoc-S-trityl monomers by known methods ("*Bioorganic Chemistry: Peptides and Proteins*", Oxford University Press, New York: 1998, the entire contents of which are incorporated herein by reference). The precursor peptidomimetic is then deprotected and cleaved from the solid-phase resin by standard conditions (e.g., strong acid such as 95% TFA). The precursor peptidomimetic is reacted as a crude mixture or is purified prior to reaction with X-L$_2$-Y in organic or aqueous solutions. In some embodiments the alkylation reaction is performed under dilute conditions (i.e. 0.15 mmol/L) to favor macrocyclization and to avoid polymerization. In some embodiments, the alkylation reaction is performed in organic solutions such as liquid NH$_3$ (Mosberg et al. (1985), *J. Am. Chem. Soc.* 107:2986-2987; Szewczuk et al. (1992), *Int. J. Peptide Protein Res.* 40:233-242), NH$_3$/MeOH, or NH$_3$/DMF (Or et al. (1991), *J. Org. Chem.* 56:3146-3149). In other embodiments, the alkylation is performed in an aqueous solution such as 6M guanidinium HCL, pH 8 (Brunel et al. (2005), *Chem. Commun.* (20):2552-2554). In other embodiments, the solvent used for the alkylation reaction is DMF or dichloroethane.

Synthetic Scheme 7:

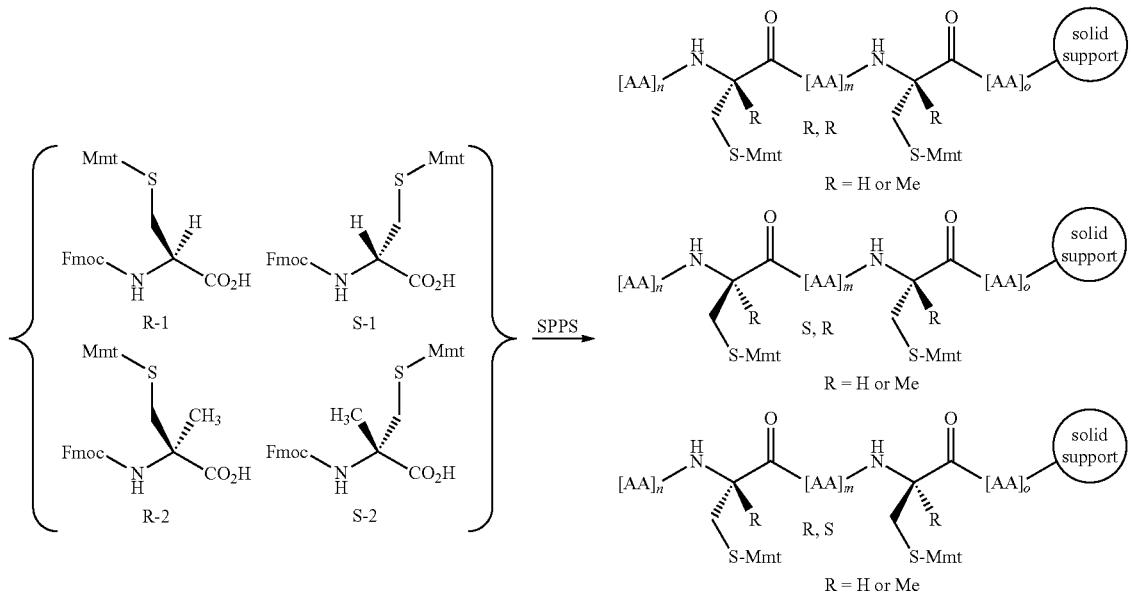

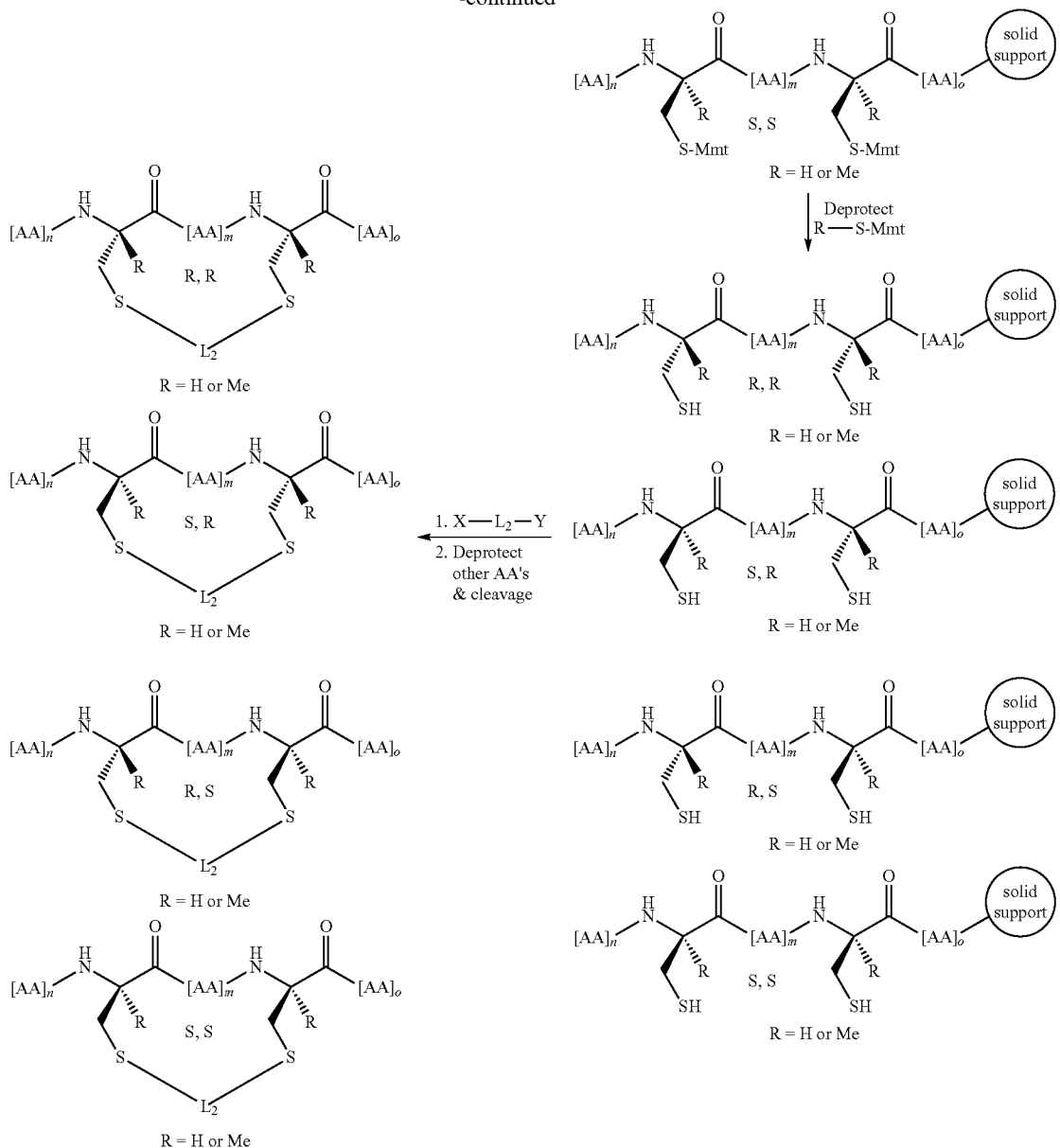

In Scheme 7, the precursor peptidomimetic contains two or more —SH moieties, of which two are specially protected to allow their selective deprotection and subsequent alkylation for macrocycle formation. The precursor peptidomimetic is synthesized by solid-phase peptide synthesis (SPPS) using commercially available N-α-Fmoc amino acids such as N-α-Fmoc-S-p-methoxytrityl-L-cysteine or N-α-Fmoc-S-p-methoxytrityl-D-cysteine. Alpha-methylated versions of D-cysteine or L-cysteine are generated by known methods (Seebach et al. (1996), *Angew. Chem. Int. Ed Engl.* 35:2708-2748, and references therein) and then converted to the appropriately protected N-α-Fmoc-S-p-methoxytrityl monomers by known methods (*Bioorganic Chemistry: Peptides and Proteins*, Oxford University Press, New York: 1998, the entire contents of which are incorporated herein by reference). The Mmt protecting groups of the peptidomimetic precursor are then selectively cleaved by standard conditions (e.g., mild acid such as 1% TFA in DCM). The precursor peptidomimetic is then reacted on the resin with X-L$_2$-Y in an organic solution. For example, the reaction takes place in the presence of a hindered base such as diisopropylethylamine. In some embodiments, the alkylation reaction is performed in organic solutions such as liquid NH$_3$ (Mosberg et al. (1985), *J. Am. Chem. Soc.* 107:2986-2987; Szewczuk et al. (1992), *Int. J. Peptide Protein Res.* 40:233-242), NH$_3$/MeOH or NH$_3$/DMF (Or et al. (1991), *J. Org. Chem.* 56:3146-3149). In other embodiments, the alkylation reaction is performed in DMF or dichloroethane. The peptidomimetic macrocycle is then deprotected and cleaved from the solid-phase resin by standard conditions (e.g., strong acid such as 95% TFA).

Synthetic Scheme 8:

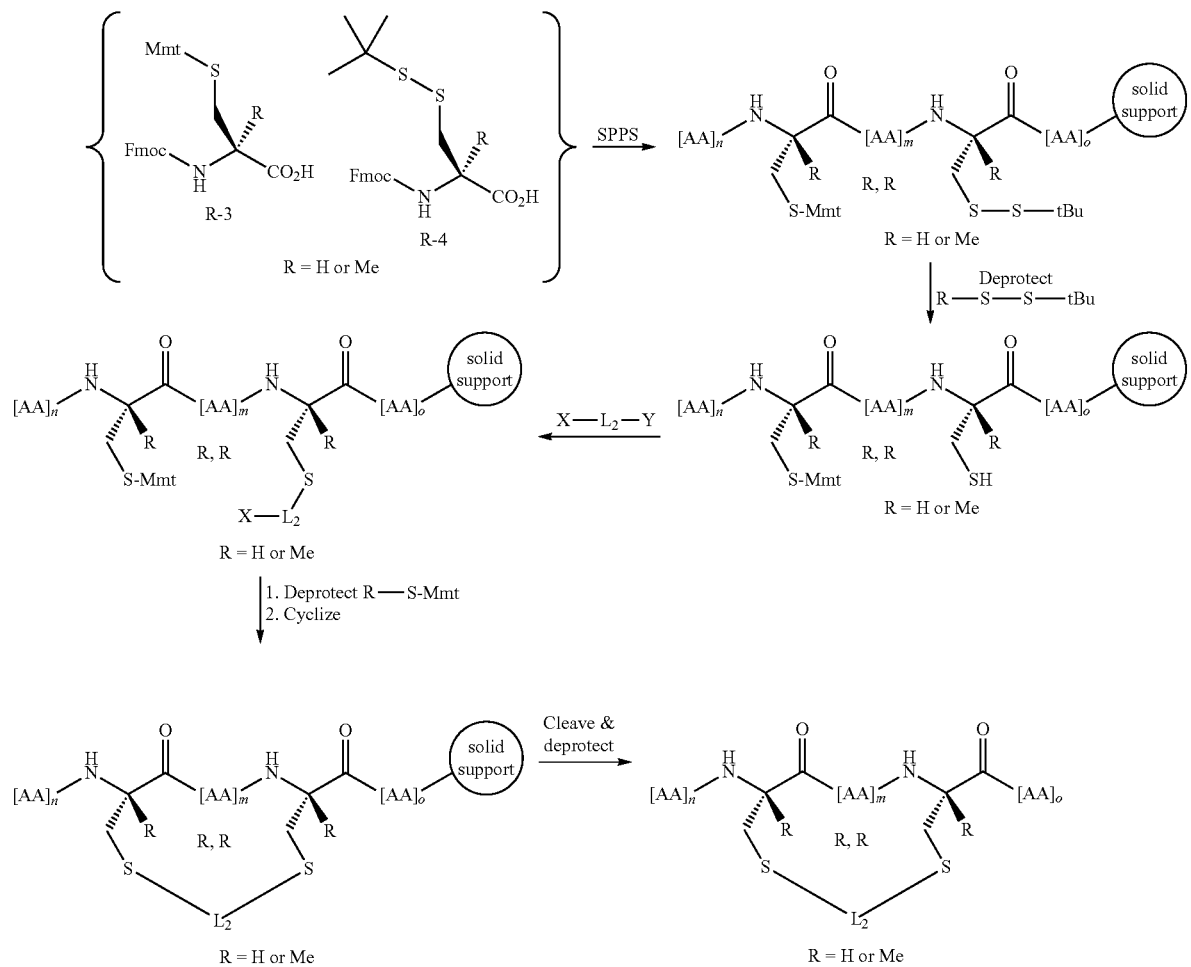

In Scheme 8, the peptidomimetic precursor contains two or more —SH moieties, of which two are specially protected to allow their selective deprotection and subsequent alkylation for macrocycle formation. The peptidomimetic precursor is synthesized by solid-phase peptide synthesis (SPPS) using commercially available N-α-Fmoc amino acids such as N-α-Fmoc-S-p-methoxytrityl-L-cysteine, N-α-Fmoc-S-p-methoxytrityl-D-cysteine, N-α-Fmoc-S—S-t-butyl-L-cysteine, and N-α-Fmoc-S—S-t-butyl-D-cysteine. Alpha-methylated versions of D-cysteine or L-cysteine are generated by known methods (Seebach et al. (1996), *Angew. Chem. Int. Ed Engl.* 35:2708-2748, and references therein) and then converted to the appropriately protected N-α-Fmoc-S-p-methoxytrityl or N-α-Fmoc-S—S-t-butyl monomers by known methods (*Bioorganic Chemistry: Peptides and Proteins*, Oxford University Press, New York: 1998, the entire contents of which are incorporated herein by reference). The S—S-tButyl protecting group of the peptidomimetic precursor is selectively cleaved by known conditions (e.g., 20% 2-mercaptoethanol in DMF, reference: Galande et al. (2005), *J. Comb. Chem.* 7:174-177). The precursor peptidomimetic is then reacted on the resin with a molar excess of X-L$_2$-Y in an organic solution. For example, the reaction takes place in the presence of a hindered base such as diisopropylethylamine. The Mmt protecting group of the peptidomimetic precursor is then selectively cleaved by standard conditions (e.g., mild acid such as 1% TFA in DCM). The peptidomimetic precursor is then cyclized on the resin by treatment with a hindered base in organic solutions. In some embodiments, the alkylation reaction is performed in organic solutions such as NH$_3$/MeOH or NH$_3$/DMF (Or et al. (1991), *J. Org. Chem.* 56:3146-3149). The peptidomimetic macrocycle is then deprotected and cleaved from the solid-phase resin by standard conditions (e.g., strong acid such as 95% TFA).

Synthetic Scheme 9:

1. Biological synthesis of peptide
2. Purification of peptide

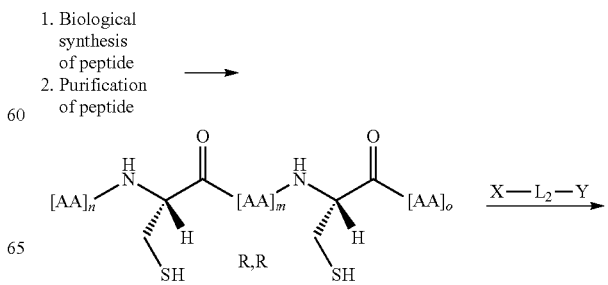

-continued

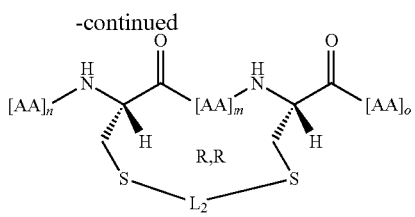

In Scheme 9, the peptidomimetic precursor contains two L-cysteine moieties. The peptidomimetic precursor is synthesized by known biological expression systems in living cells or by known in vitro, cell-free, expression methods. The precursor peptidomimetic is reacted as a crude mixture or is purified prior to reaction with X-L2-Y in organic or aqueous solutions. In some embodiments the alkylation reaction is performed under dilute conditions (i.e. 0.15 mmol/L) to favor macrocyclization and to avoid polymerization. In some embodiments, the alkylation reaction is performed in organic solutions such as liquid $NH_3$ (Mosberg et al. (1985), J. Am. Chem. Soc. 107:2986-2987; Szewczuk et al. (1992), Int. J. Peptide Protein Res. 40:233-242), $NH_3$/MeOH, or $NH_3$/DMF (Or et al. (1991), J. Org. Chem. 56:3146-3149). In other embodiments, the alkylation is performed in an aqueous solution such as 6M guanidinium HCL, pH 8 (Brunel et al. (2005), Chem. Commun. (20): 2552-2554). In other embodiments, the alkylation is performed in DMF or dichloroethane. In another embodiment, the alkylation is performed in non-denaturing aqueous solutions, and in yet another embodiment the alkylation is performed under conditions that favor α-helical structure formation. In yet another embodiment, the alkylation is performed under conditions that favor the binding of the precursor peptidomimetic to another protein, so as to induce the formation of the bound α-helical conformation during the alkylation.

Various embodiments for X and Y are envisioned which are suitable for reacting with thiol groups. In general, each X or Y is independently be selected from the general category shown in Table 3. For example, X and Y are halides such as —Cl, —Br or —I. Any of the macrocycle-forming linkers described herein may be used in any combination with any of the sequences shown and also with any of the R— substituents indicated herein.

TABLE 3

Examples of Reactive Groups Capable of Reacting with Thiol Groups and Resulting Linkages

| X or Y | Resulting Covalent Linkage |
|---|---|
| acrylamide | Thioether |
| halide (e.g. alkyl or aryl halide) | Thioether |
| sulfonate | Thioether |
| aziridine | Thioether |
| epoxide | Thioether |
| haloacetamide | Thioether |
| maleimide | Thioether |
| sulfonate ester | Thioether |

The present invention contemplates the use of both naturally occurring and non-naturally-occurring amino acids and amino acid analogs in the synthesis of the peptidomimetic macrocycles of Formula IV. Any amino acid or amino acid analog amenable to the synthetic methods employed for the synthesis of stable bis-sulfhydryl containing peptidomimetic macrocycles can be used in the present invention. For example, cysteine is contemplated as a useful amino acid in the present invention. However, sulfur containing amino acids other than cysteine that contain a different amino acid side chain are also useful. For example, cysteine contains one methylene unit between the α-carbon of the amino acid and the terminal —SH of the amino acid side chain. The invention also contemplates the use of amino acids with multiple methylene units between the α-carbon and the terminal —SH. Non-limiting examples include α-methyl-L-homocysteine and α-methyl-D-homocysteine. In some embodiments the amino acids and amino acid analogs are of the D-configuration. In other embodiments they are of the L-configuration. In some embodiments, some of the amino acids and amino acid analogs contained in the peptidomimetic are of the D-configuration while some of the amino acids and amino acid analogs are of the L-configuration. In some embodiments the amino acid analogs are α,α-disubstituted, such as α-methyl-L-cysteine and α-methyl-D-cysteine.

The invention includes macrocycles in which macrocycle-forming linkers are used to link two or more —SH moieties in the peptidomimetic precursors to form the peptidomimetic macrocycles disclosed herein. As described above, the macrocycle-forming linkers impart conformational rigidity, increased metabolic stability or increased cell penetrability. Furthermore, in some embodiments, the macrocycle-forming linkages stabilize the α-helical secondary structure of the peptidomimetic macrocyles. The macrocycle-forming linkers are of the formula $X-L_2-Y$, wherein both X and Y are the same or different moieties, as defined above. Both X and Y have the chemical characteristics that allow one macrocycle-forming linker $-L_2-$ to bis alkylate the bis-sulfhydryl containing peptidomimetic precursor. As defined above, the linker $-L_2-$ includes alkylene, alkenylene, alkynylene, heteroalkylene, cycloalkylene, heterocycloalkylene, cycloarylene, or heterocycloarylene, or $—R_4—K—R_4—$, all of which can be optionally substituted with an $R_5$ group, as defined above. Furthermore, one to three carbon atoms within the macrocycle-forming linkers $-L_2-$, other than the carbons attached to the —SH of the sulfhydryl containing amino acid, are optionally substituted with a heteroatom such as N, S or O.

The $L_2$ component of the macrocycle-forming linker $X-L_2-Y$ may be varied in length depending on, among other things, the distance between the positions of the two amino acid analogs used to form the peptidomimetic macrocycle. Furthermore, as the lengths of $L_1$ or $L_3$ components of the macrocycle-forming linker are varied, the length of $L_2$ can also be varied in order to create a linker of appropriate overall length for forming a stable peptidomimetic macrocycle. For example, if the amino acid analogs used are varied by adding an additional methylene unit to each of $L_1$ and $L_3$, the length of $L_2$ are decreased in length by the equivalent of approximately two methylene units to compensate for the increased lengths of $L_1$ and $L_3$.

In some embodiments, $L_2$ is an alkylene group of the formula $—(CH_2)_n—$, where n is an integer between about 1 and about 15. For example, n is 1, 2, 3, 4, 5, 6, 7, 8, 9 or 10. In other embodiments, $L_2$ is an alkenylene group. In still other embodiments, $L_2$ is an aryl group.

Table 4 shows additional embodiments of X-L$_2$-Y groups.
TABLE 4
Exemplary X-L$_2$-Y groups.
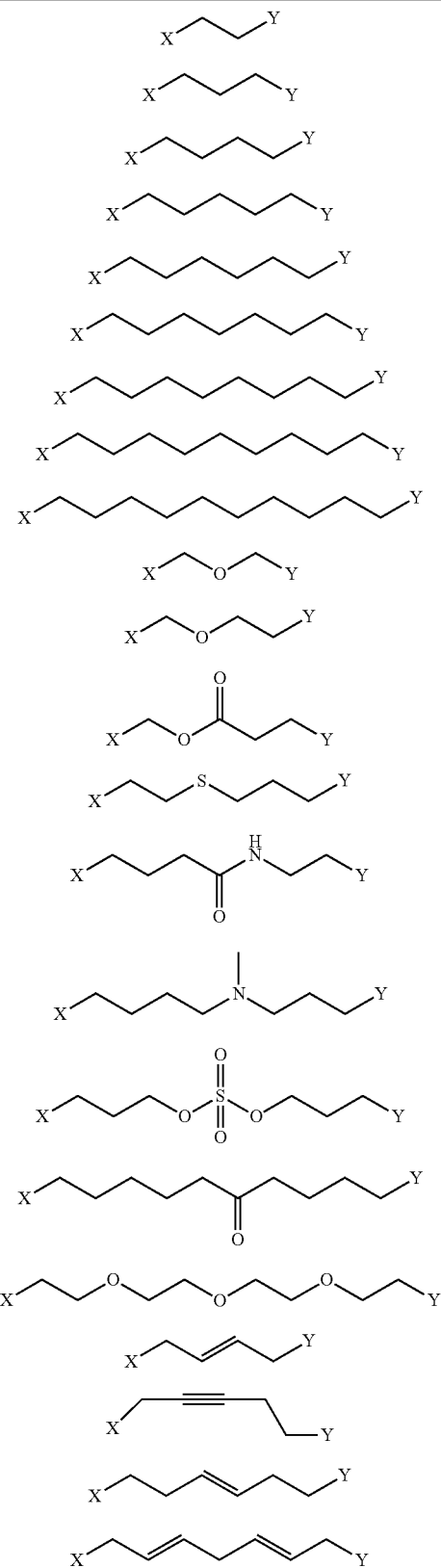

TABLE 4-continued
Exemplary X-L$_2$-Y groups.
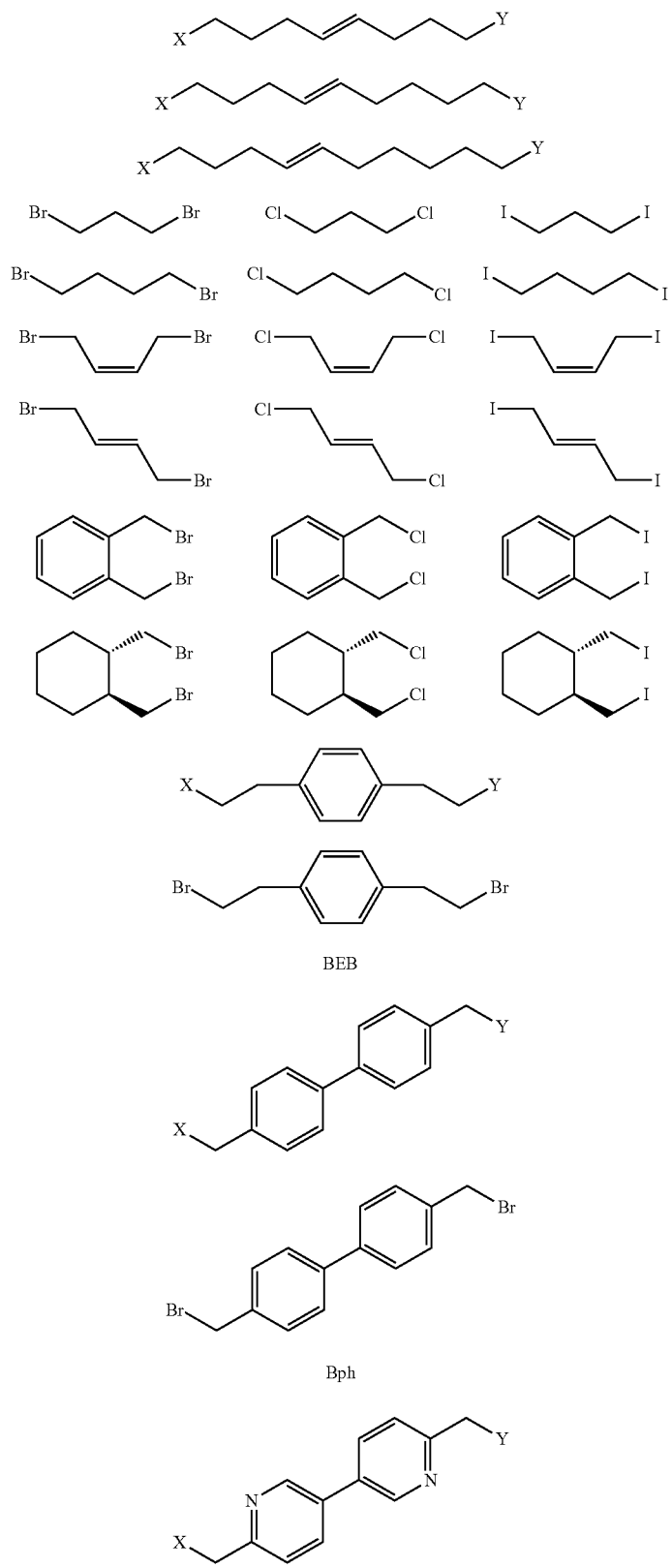

TABLE 4-continued

Exemplary X-L₂-Y groups.

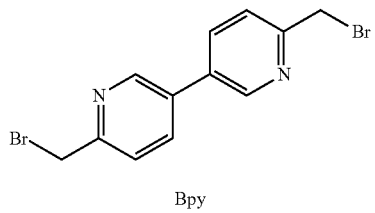 [SMILES: BrCc1ccc(-c2ccc(CBr)nc2)cn1]

Bpy

Each X and Y in this Table, is, for example, independently Cl—, Br—, I—.

Additional methods of forming peptidomimetic macrocycles which are envisioned as suitable to perform the present invention include those disclosed by Mustapa, M. Firouz Mohd et al., J. Org. Chem (2003), 68, pp. 8193-8198; Yang, Bin et al. Bioorg Med. Chem. Lett. (2004), 14, pp. 1403-1406; U.S. Pat. No. 5,364,851; U.S. Pat. No. 5,446,128; U.S. Pat. No. 5,824,483; U.S. Pat. No. 6,713,280; and U.S. Pat. No. 7,202,332. In such embodiments, amino acid precursors are used containing an additional substituent R— at the alpha position. Such amino acids are incorporated into the macrocycle precursor at the desired positions, which may be at the positions where the crosslinker is substituted or, alternatively, elsewhere in the sequence of the macrocycle precursor. Cyclization of the precursor is then performed according to the indicated method.

For example, a peptidomimetic macrocycle of Formula (II) is prepared as indicated:

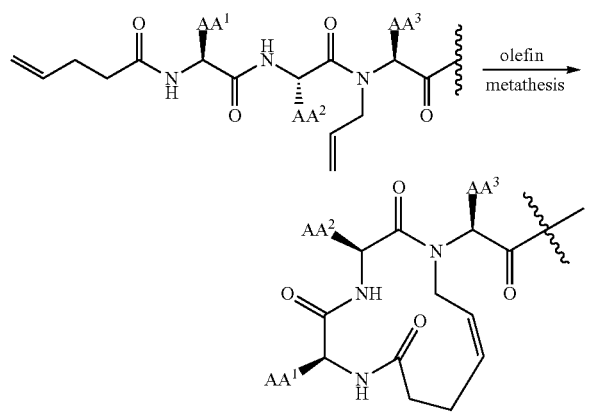

wherein each AA1, AA2, AA3 is independently an amino acid side chain.

In other embodiments, a peptidomimetic macrocycle of Formula (II) is prepared as indicated:

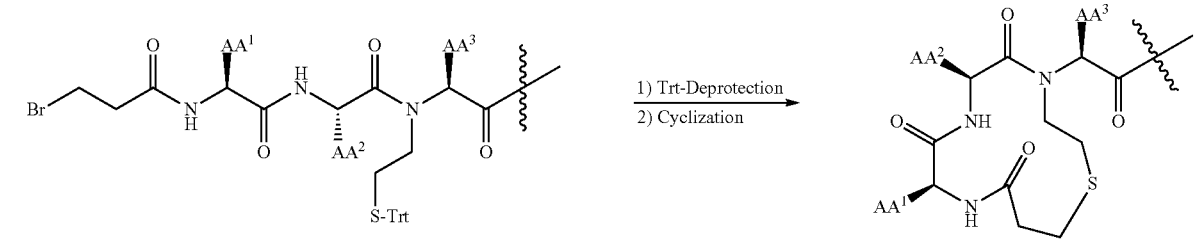

wherein each AA1, AA2, AA3 is independently an amino acid side chain.

In some embodiments, a peptidomimetic macrocycle is obtained in more than one isomer, for example due to the configuration of a double bond within the structure of the crosslinker (E vs Z). Such isomers can or can not be separable by conventional chromatographic methods. In some embodiments, one isomer has improved biological properties relative to the other isomer. In one embodiment, an E crosslinker olefin isomer of a peptidomimetic macrocycle has better solubility, better target affinity, better in vivo or in vitro efficacy, higher helicity, or improved cell permeability relative to its Z counterpart. In another embodiment, a Z crosslinker olefin isomer of a peptidomimetic macrocycle has better solubility, better target affinity, better in vivo or in vitro efficacy, higher helicity, or improved cell permeability relative to its E counterpart.

A compound described herein can be at least 1% pure, at least 2% pure, at least 3% pure, at least 4% pure, at least 5% pure, at least 6% pure, at least 7% pure, at least 8% pure, at least 9% pure, at least 10% pure, at least 11% pure, at least 12% pure, at least 13% pure, at least 14% pure, at least 15% pure, at least 16% pure, at least 17% pure, at least 18% pure, at least 19% pure, at least 20% pure, at least 21% pure, at least 22% pure, at least 23% pure, at least 24% pure, at least 25% pure, at least 26% pure, at least 27% pure, at least 28% pure, at least 29% pure, at least 30% pure, at least 31% pure, at least 32% pure, at least 33% pure, at least 34% pure, at least 35% pure, at least 36% pure, at least 37% pure, at least 38% pure, at least 39% pure, at least 40% pure, at least 41% pure, at least 42% pure, at least 43% pure, at least 44% pure, at least 45% pure, at least 46% pure, at least 47% pure, at least 48% pure, at least 49% pure, at least 50% pure, at least 51% pure, at least 52% pure, at least 53% pure, at least 54% pure, at least 55% pure, at least 56% pure, at least 57% pure, at least 58% pure, at least 59% pure, at least 60% pure, at least 61% pure, at least 62% pure, at least 63% pure, at least 64% pure, at least 65% pure, at least 66% pure, at least 67% pure, at least 68% pure, at least 69% pure, at least 70% pure, at least 71% pure, at least 72% pure, at least 73% pure, at least 74% pure, at least 75% pure, at least 76% pure, at least 77% pure, at least 78% pure, at least 79% pure, at least 80% pure, at least 81% pure, at least 82% pure, at least 83% pure, at least 84% pure, at least 85% pure, at least 86% pure, at least 87% pure, at least 88% pure, at least 89% pure, at least 90% pure, at least 91% pure, at least 92% pure, at least 93% pure, at least 94% pure, at least 95% pure, at least 96% pure, at least 97% pure, at least 98% pure, at least 99% pure, at least 99.1% pure, at least 99.2% pure, at least 99.3% pure, at least 99.4% pure, at least 99.5% pure, at least 99.6% pure, at least 99.7% pure, at least 99.8% pure, or at least 99.9% pure on a chemical, optical, isomeric, enantiomeric, or diastereomeric basis. Purity can be assessed, for example, by HPLC, MS, LC/MS, melting point, or NMR.

Assays

The properties of the peptidomimetic macrocycles of the invention are assayed, for example, by using the methods described below. In some embodiments, a peptidomimetic macrocycle of the invention has improved biological properties relative to a corresponding polypeptide lacking the substituents described herein.

In some embodiments, a peptidomimetic macrocycle disclosed herein binds MCL-1 selectively over another protein that has a BH3 domain. In some embodiments, the selectivity is a ratio of about 2 to about 1, about 3 to about 1, about 4 to about 1, about 5 to about 1, about 6 to about 1, about 7 to about 1, about 8 to about 1, about 9 to about 1, about 10 to about 1, about 20 to about 1, about 30 to about 1, about 40 to about 1, about 50 to about 1, about 60 to about 1, about 70 to about 1, about 80 to about 1, about 90 to about 1, about 100 to about 1, about 200 to about 1, about 300 to about 1, about 400 to about 1, about 500 to about 1, about 600 to about 1, about 700 to about 1, about 800 to about 1, about 900 to about 1, or about 1000 to about 1.

In some embodiments, a peptidomimetic macrocycle disclosed herein non-selectively binds additional types of proteins that have a BH3 domain. In some embodiments, the non-selectivity is at least about 2 types of proteins, at least about 3 types of proteins, at least about 4 types of proteins, at least about 5 types of proteins, at least about 6 types of proteins, at least about 7 types of proteins, at least about 8 types of proteins, at least about 9 types of proteins, at least about 10 types of proteins, at least about 11 types of protein, at least about 12 types of proteins, at least about 13 types of proteins, at least about 14 types of proteins, at least about 15 types of proteins, at least about 16 types of proteins, at least about 17 types of proteins, at least about 18 types of proteins, at least about 19 types of proteins, or at least about 20 types of proteins. In some embodiments, the non-selectivity is from about 2 types of protein to about 3 types of protein, from about 3 types of protein to about 4 types of protein, from about 4 types of protein to about 5 types of protein, from about 5 types of protein to about 6 types of protein, from about 6 types of protein to about 7 types of protein, from about 7 types of protein to about 8 types of protein, from about 8 types of protein to about 9 types of protein, from about 9 types of protein to about 10 types of protein, from about 10 types of protein to about 11 types of protein, from about 11 types of protein to about 12 types of protein, from about 12 types of protein to about 13 types of protein, from about 13 types of protein to about 14 types of protein, from about 14 types of protein to about 15 types of protein, from about 15 types of protein to about 16 types of protein, from about 16 types of protein to about 17 types of protein, from about 17 types of protein to about 18 types of protein, from about 18 types of protein to about 19 types of protein, or from about 19 types of protein to about 20 types of protein.

Assay to Determine α-Helicity.

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles of the invention will possess an alpha-helicity of greater than 50%. To assay the helicity of peptidomimetic macrocycles of the invention, the compounds are dissolved in an aqueous solution (e.g. 50 mM potassium phosphate solution at pH 7, or distilled $H_2O$, to concentrations of 25-50 μM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222obs) by the reported value for a model helical decapeptide (Yang et al. (1986), *Methods Enzymol.* 130:208)).

Assay to Determine Melting Temperature (Tm).

A peptidomimetic macrocycle of the invention comprising a secondary structure such as an α-helix exhibits, for example, a higher melting temperature than a corresponding uncrosslinked polypeptide. Typically peptidomimetic macrocycles of the invention exhibit Tm of >60° C. representing a highly stable structure in aqueous solutions. To assay the effect of macrocycle formation on melting temperature, peptidomimetic macrocycles or unmodified peptides are dissolved in distilled $H_2O$ (e.g. at a final concentration of 50 μM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay.

The amide bond of the peptide backbone is susceptible to hydrolysis by proteases, thereby rendering peptidic compounds vulnerable to rapid degradation in vivo. Peptide helix formation, however, typically buries the amide backbone and therefore may shield it from proteolytic cleavage. The peptidomimetic macrocycles of the present invention may be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E ~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln [S] versus time (k=−1Xslope).

Ex Vivo Stability Assay.

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays may be used. For example, a peptidomimetic macrocycle and a corresponding uncrosslinked polypeptide (2 mcg) are incubated with fresh mouse, rat or human serum (2 mL) at 37° C. for 0, 1, 2, 4, 8, and 24 hours. To determine the level of intact compound, the following procedure may be used: The samples are extracted by transferring 100 μl of sera to 2 ml centrifuge tubes followed by the addition of 10 μL of 50% formic acid and 500 μL acetonitrile and centrifugation at 14,000 RPM for 10 min at 4±2° C. The supernatants are then transferred to fresh 2 ml tubes and evaporated on Turbovap under $N_2$<10 psi, 37° C. The samples are reconstituted in 100 μL of 50:50 acetonitrile:water and submitted to LC-MS/MS analysis.

In Vitro Binding Assays.

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values may be determined by nonlinear regression analysis using, for example, Graphpad Prism software (GraphPad Software, Inc., San Diego, Calif.). A peptidomimetic macrocycle of the invention shows, in some instances, similar or lower Kd than a corresponding uncrosslinked polypeptide.

In Vitro Displacement Assays to Characterize Antagonists of Peptide-Protein Interactions.

To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values may be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay.

Assay for Protein-Ligand Binding by Affinity Selection-Mass Spectrometry.

To assess the binding and affinity of test compounds for proteins, an affinity-selection mass spectrometry assay is used, for example. Protein-ligand binding experiments are conducted according to the following representative procedure outlined for a system-wide control experiment using 1 μM peptidomimetic macrocycle plus 5 μM target protein. A 1 μL DMSO aliquot of a 40 μM stock solution of peptidomimetic macrocycle is dissolved in 19 μL of PBS (Phosphate-buffered saline: 50 mM, pH 7.5 Phosphate buffer containing 150 mM NaCl). The resulting solution is mixed by repeated pipetting and clarified by centrifugation at 10 000 g for 10 min. To a 4 μL aliquot of the resulting supernatant is added 4 μL of 10 μM target protein in PBS. Each 8.0 μL experimental sample thus contains 40 pmol (1.5 μg) of protein at 5.0 μM concentration in PBS plus 1 μM peptidomimetic macrocycle and 2.5% DMSO. Duplicate samples thus prepared for each concentration point are incubated for 60 min at room temperature, and then chilled to 4° C. prior to size-exclusion chromatography-LC-MS analysis of 5.0 μL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column. After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

Assay for Protein-Ligand $K_d$ Titration Experiments.

To assess the binding and affinity of test compounds for proteins, a protein-ligand Kd titration experiment is performed. Protein-ligand $K_d$ titrations experiments are conducted as follows: 2 μL DMSO aliquots of a serially diluted stock solution of titrant peptidomimetic macrocycle (5, 2.5, . . . , 0.098 mM) are prepared then dissolved in 38 μL of PBS. The resulting solutions are mixed by repeated pipetting and clarified by centrifugation at 10 000 g for 10 min. To 4.0 μL aliquots of the resulting supernatants is added 4.0 μL of 10 μM target protein in PBS. Each 8.0 μL experimental sample thus contains 40 pmol (1.5 μg) of protein at 5.0 μM concentration in PBS, varying concentrations (125, 62.5, . . . , 0.24 μM) of the titrant peptide, and 2.5% DMSO. Duplicate samples thus prepared for each concentration point are incubated at room temperature for 30 min, then chilled to 4° C. prior to SEC-LC-MS analysis of 2.0 μL injections. The $(M+H)^{1+}$, $(M+2H)^{2+}$, $(M+3H)^{3+}$, or $(M+Na)^{1+}$ ion is observed by ESI-MS; extracted ion chromatograms are quantified, then fit to equations to derive the binding affinity $K_d$ as described in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Assay for Competitive Binding Experiments by Affinity Selection-Mass Spectrometry.

To determine the ability of test compounds to bind competitively to proteins, an affinity selection mass spectrometry assay is performed, for example. A mixture of ligands at 40 µM per component is prepared by combining 2 µL aliquots of 400 µM stocks of each of the three compounds with 14 µL of DMSO. Then, 1 µL aliquots of this 40 µM per component mixture are combined with 1 µL DMSO aliquots of a serially diluted stock solution of titrant peptidomimetic macrocycle (10, 5, 2.5, . . . , 0.078 mM). These 2 µL samples are dissolved in 38 µL of PBS. The resulting solutions were mixed by repeated pipetting and clarified by centrifugation at 10 000 g for 10 min. To 4.0 µL aliquots of the resulting supernatants is added 4.0 µL of 10 µM target protein in PBS. Each 8.0 µL experimental sample thus contains 40 pmol (1.5 µg) of protein at 5.0 µM concentration in PBS plus 0.5 µM ligand, 2.5% DMSO, and varying concentrations (125, 62.5, . . . , 0.98 µM) of the titrant peptidomimetic macrocycle. Duplicate samples thus prepared for each concentration point are incubated at room temperature for 60 min, then chilled to 4° C. prior to SEC-LC-MS analysis of 2.0 µL injections. Additional details on these and other methods are provided in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Binding Assays in Intact Cells.

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µl goat anti-FITC antibody for 2 hrs, rotating at 4° C. followed by further 2 hrs incubation at 4° C. with protein A/G Sepharose (50 µl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

Cellular Penetrability Assays.

To measure the cell penetrability of peptidomimetic macrocycles and corresponding uncrosslinked macrocycle, intact cells are incubated with fluoresceinated peptidomimetic macrocycles or corresponding uncrosslinked macrocycle (10 µM) for 4 hrs in serum free media at 37° C., washed twice with media and incubated with trypsin (0.25%) for 10 min at 37° C. The cells are washed again and resuspended in PBS. Cellular fluorescence is analyzed, for example, by using either a FACSCalibur flow cytometer or Cellomics' KineticScan® HCS Reader.

In Vivo Stability Assays.

To investigate the in vivo stability of the peptidomimetic macrocycles, the compounds are, for example, administered to mice or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

Clinical Trials.

To determine the suitability of the peptidomimetic macrocycles of the invention for treatment of humans, clinical trials are performed. For example, patients diagnosed with a muscle wasting disease or lipodystrophy and in need of treatment are selected and separated in treatment and one or more control groups, wherein the treatment group is administered a peptidomimetic macrocycle of the invention, while the control groups receive a placebo or a known BH3 mimetic. The treatment safety and efficacy of the peptidomimetic macrocycles of the invention can thus be evaluated by performing comparisons of the patient groups with respect to factors such as survival and quality-of-life. In this example, the patient group treated with a peptidomimetic macrocycle show improved long-term survival compared to a patient control group treated with a placebo.

Pharmaceutical Compositions and Routes of Administration

In some embodiments, the present invention provides a pharmaceutical composition comprising a peptidomimetic macrocycle of the invention and a pharmaceutically acceptable carrier.

The peptidomimetic macrocycles of the invention also include pharmaceutically acceptable derivatives or prodrugs thereof. A "pharmaceutically acceptable derivative" means any pharmaceutically acceptable salt, ester, salt of an ester, pro-drug or other derivative of a compound of this invention which, upon administration to a recipient, is capable of providing (directly or indirectly) a compound of this invention. Particularly favored pharmaceutically acceptable derivatives are those that increase the bioavailability of the compounds of the invention when administered to a mammal (e.g., by increasing absorption into the blood of an orally administered compound) or which increases delivery of the active compound to a biological compartment (e.g., the brain or lymphatic system) relative to the parent species. Some pharmaceutically acceptable derivatives include a chemical group which increases aqueous solubility or active transport across the gastrointestinal mucosa.

In some embodiments, the peptidomimetic macrocycles of the invention are modified by covalently or non-covalently joining appropriate functional groups to enhance selective biological properties. Such modifications include those which increase biological penetration into a given biological compartment (e.g., blood, lymphatic system, central nervous system), increase oral availability, increase solubility to allow administration by injection, alter metabolism, and alter rate of excretion.

Pharmaceutically acceptable salts of the compounds of this invention include those derived from pharmaceutically acceptable inorganic and organic acids and bases. Examples of suitable acid salts include acetate, adipate, benzoate, benzenesulfonate, butyrate, citrate, digluconate, dodecylsulfate, formate, fumarate, glycolate, hemisulfate, heptanoate, hexanoate, hydrochloride, hydrobromide, hydroiodide, lactate, maleate, malonate, methanesulfonate, 2-naphthalene-sulfonate, nicotinate, nitrate, palmoate, phosphate, picrate, pivalate, propionate, salicylate, succinate, sulfate, tartrate, tosylate and undecanoate. Salts derived from appropriate bases include alkali metal (e.g., sodium), alkaline earth metal (e.g., magnesium), ammonium and N-(alkyl)$_4^+$ salts.

For preparing pharmaceutical compositions from the compounds of the present invention, pharmaceutically acceptable carriers include either solid or liquid carriers. Solid form preparations include powders, tablets, pills, capsules, cachets, suppositories, and dispersible granules. A solid carrier can be one or more substances, which also acts as diluents, flavoring agents, binders, preservatives, tablet disintegrating agents, or an encapsulating material. Details on techniques for formulation and administration are well described in the scientific and patent literature, see, e.g., the latest edition of Remington's Pharmaceutical Sciences, Maack Publishing Co, Easton Pa.

In powders, the carrier is a finely divided solid, which is in a mixture with the finely divided active component. In tablets, the active component is mixed with the carrier having the necessary binding properties in suitable proportions and compacted in the shape and size desired.

Suitable solid excipients are carbohydrate or protein fillers include, but are not limited to sugars, including lactose, sucrose, mannitol, or sorbitol; starch from corn, wheat, rice, potato, or other plants; cellulose such as methyl cellulose, hydroxypropylmethyl-cellulose, or sodium carboxymethylcellulose; and gums including arabic and tragacanth; as well as proteins such as gelatin and collagen. If desired, disintegrating or solubilizing agents are added, such as the cross-linked polyvinyl pyrrolidone, agar, alginic acid, or a salt thereof, such as sodium alginate.

Liquid form preparations include solutions, suspensions, and emulsions, for example, water or water/propylene glycol solutions. For parenteral injection, liquid preparations can be formulated in solution in aqueous polyethylene glycol solution.

The pharmaceutical preparation is preferably in unit dosage form. In such form the preparation is subdivided into unit doses containing appropriate quantities of the active component. The unit dosage form can be a packaged preparation, the package containing discrete quantities of preparation, such as packeted tablets, capsules, and powders in vials or ampoules. Also, the unit dosage form can be a capsule, tablet, cachet, or lozenge itself, or it can be the appropriate number of any of these in packaged form.

When the compositions of this invention comprise a combination of a peptidomimetic macrocycle and one or more additional therapeutic or prophylactic agents, both the compound and the additional agent should be present at dosage levels of between about 1 to 100%, and more preferably between about 5 to 95% of the dosage normally administered in a monotherapy regimen. In some embodiments, the additional agents are administered separately, as part of a multiple dose regimen, from the compounds of this invention. Alternatively, those agents are part of a single dosage form, mixed together with the compounds of this invention in a single composition.

In some embodiments, the compositions are present as unit dosage forms that can deliver, for example, from about 0.0001 mg to about 1,000 mg of the peptidomimetic macrocycles, salts thereof, prodrugs thereof, derivatives thereof, or any combination of these. Thus, the unit dosage forms can deliver, for example, in some embodiments, from about 1 mg to about 900 mg, from about 1 mg to about 800 mg, from about 1 mg to about 700 mg, from about 1 mg to about 600 mg, from about 1 mg to about 500 mg, from about 1 mg to about 400 mg, from about 1 mg to about 300 mg, from about 1 mg to about 200 mg, from about 1 mg to about 100 mg, from about 1 mg to about 10 mg, from about 1 mg to about 5 mg, from about 0.1 mg to about 10 mg, from about 0.1 mg to about 5 mg, from about 10 mg to about 1,000 mg, from about 50 mg to about 1,000 mg, from about 100 mg to about 1,000 mg, from about 200 mg to about 1,000 mg, from about 300 mg to about 1,000 mg, from about 400 mg to about 1,000 mg, from about 500 mg to about 1,000 mg, from about 600 mg to about 1,000 mg, from about 700 mg to about 1,000 mg, from about 800 mg to about 1,000 mg, from about 900 mg to about 1,000 mg, from about 10 mg to about 900 mg, from about 100 mg to about 800 mg, from about 200 mg to about 700 mg, or from about 300 mg to about 600 mg of the peptidomimetic macrocycles, salts thereof, prodrugs thereof, derivatives thereof, or any combination of these.

In some embodiments, the compositions are present as unit dosage forms that can deliver, for example, about 1 mg, about 2 mg, about 3 mg, about 4 mg, about 5 mg, about 6 mg, about 7 mg, about 8 mg, about 9 mg, about 10 mg, about 20 mg, about 30 mg, about 40 mg, about 50 mg, about 60 mg, about 70 mg, about 80 mg, about 90 mg, about 100 mg, about 150 mg, about 200 mg, about 250 mg, about 300 mg, about 350 mg, about 400 mg, about 500 mg, about 600 mg, about 700 mg, about 800 mg, or about 1000 mg of peptidomimetic macrocycles, salts thereof, prodrugs thereof, derivatives thereof, or any combination of these.

Suitable routes of administration include, but are not limited to, oral, intravenous, rectal, aerosol, parenteral, ophthalmic, pulmonary, transmucosal, transdermal, vaginal, otic, nasal, and topical administration. In addition, by way of example only, parenteral delivery includes intramuscular, subcutaneous, intravenous, intramedullary injections, as well as intrathecal, direct intraventricular, intraperitoneal, intralymphatic, and intranasal injections.

In certain embodiments, a composition as described herein is administered in a local rather than systemic manner, for example, via injection of the compound directly into an organ. In specific embodiments, long acting formulations are administered by implantation (for example subcutaneously or intramuscularly) or by intramuscular injection. Furthermore, in other embodiments, the drug is delivered in a targeted drug delivery system, for example, in a liposome coated with organ-specific antibody. In such embodiments, the liposomes are targeted to and taken up selectively by the organ. In yet other embodiments, the compound as described herein is provided in the form of a rapid release formulation, in the form of an extended release formulation, or in the form of an intermediate release formulation. In yet other embodiments, the compound described herein is administered topically.

In another embodiment, compositions described herein are formulated for oral administration. Compositions described herein are formulated by combining a peptidomimetic macrocycle with, e.g., pharmaceutically acceptable carriers or excipients. In various embodiments, the compounds described herein are formulated in oral dosage forms that include, by way of example only, tablets, powders, pills, dragees, capsules, liquids, gels, syrups, elixirs, slurries, suspensions and the like.

In certain embodiments, pharmaceutical preparations for oral use are obtained by mixing one or more solid excipient with one or more of the peptidomimetic macrocycles described herein, optionally grinding the resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as: for example, maize starch, wheat starch, rice starch, potato starch, gelatin, gum tragacanth, methylcellulose, microcrystalline cellulose, hydroxypropylmethylcellulose, sodium carboxymethylcellulose; or others such as: polyvinylpyrrolidone (PVP or povidone) or calcium phosphate. In specific embodiments, disintegrating agents are optionally added. Disintegrating agents include, by way of example only, cross-linked croscarmellose sodium, polyvinylpyrrolidone, agar, or alginic acid or a salt thereof such as sodium alginate.

In one embodiment, dosage forms, such as dragee cores and tablets, are provided with one or more suitable coating. In specific embodiments, concentrated sugar solutions are used for coating the dosage form. The sugar solutions, optionally contain additional components, such as by way of example only, gum arabic, talc, polyvinylpyrrolidone, carbopol gel, polyethylene glycol, or titanium dioxide, lacquer solutions, and suitable organic solvents or solvent mixtures. Dyestuffs or pigments are also optionally added to the coatings for identification purposes. Additionally, the dyestuffs or pigments are optionally utilized to characterize different combinations of active compound doses.

In certain embodiments, therapeutically effective amounts of at least one of the peptidomimetic macrocycles described herein are formulated into other oral dosage forms. Oral dosage forms include push-fit capsules made of gelatin, as well as soft, sealed capsules made of gelatin and a plasticizer, such as glycerol or sorbitol. In specific embodiments, push-fit capsules contain the active ingredients in admixture with one or more filler. Fillers include, by way of example only, lactose, binders such as starches, or lubricants such as talc or magnesium stearate and, optionally, stabilizers. In other embodiments, soft capsules, contain one or more active compound that is dissolved or suspended in a suitable liquid. Suitable liquids include, by way of example only, one or more fatty oil, liquid paraffin, or liquid polyethylene glycol. In addition, stabilizers are optionally added.

In other embodiments, therapeutically effective amounts of at least one of the peptidomimetic macrocycles described herein are formulated for buccal or sublingual administration. Formulations suitable for buccal or sublingual administration include, by way of example only, tablets, lozenges, or gels. In still other embodiments, the peptidomimetic macrocycles described herein are formulated for parenteral injection, including formulations suitable for bolus injection or continuous infusion. In specific embodiments, formulations for injection are presented in unit dosage form (e.g., in ampoules) or in multi-dose containers. Preservatives are, optionally, added to the injection formulations. In still other embodiments, pharmaceutical compositions are formulated in a form suitable for parenteral injection as a sterile suspensions, solutions or emulsions in oily or aqueous vehicles. Parenteral injection formulations optionally contain formulatory agents such as suspending, stabilizing or dispersing agents. In specific embodiments, pharmaceutical formulations for parenteral administration include aqueous solutions of the active compounds in water-soluble form. In additional embodiments, suspensions of the active compounds are prepared as appropriate oily injection suspensions. Suitable lipophilic solvents or vehicles for use in the pharmaceutical compositions described herein include, by way of example only, fatty oils such as sesame oil, or synthetic fatty acid esters, such as ethyl oleate or triglycerides, or liposomes. In certain specific embodiments, aqueous injection suspensions contain substances which increase the viscosity of the suspension, such as sodium carboxymethyl cellulose, sorbitol, or dextran. Optionally, the suspension contains suitable stabilizers or agents which increase the solubility of the compounds to allow for the preparation of highly concentrated solutions. Alternatively, in other embodiments, the active ingredient is in powder form for constitution with a suitable vehicle, e.g., sterile pyrogen-free water, before use.

Pharmaceutical compositions herein can be administered, for example, once or twice or three or four or five or six times per day, or once or twice or three or four or five or six times per week, and can be administered, for example, for a day, a week, a month, 3 months, six months, a year, five years, or for example ten years. In some embodiments, a pharmaceutical formulation of the invention is administered no more frequently than once daily, no more frequently than every other day, no more frequently than twice weekly, no more frequently than three times weekly, no more frequently than four times weekly, no more frequently than five times weekly, or no more frequently than every other week. In some embodiments, a pharmaceutical formulation of the invention is administered no more than once weekly. In some embodiments, a pharmaceutical formulation of the invention is administered no more than twice weekly. In some embodiments, a pharmaceutical formulation of the invention is administered no more than three times weekly. In some embodiments, a pharmaceutical formulation of the invention is administered no more than four times weekly. In some embodiments, a pharmaceutical formulation of the invention is administered no more than five times weekly.

Methods of Use

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease. In some embodiments, a peptidomimetic macrocycle disclosed herein is used for treating a disease or condition in a subject in need thereof. In some embodiments, a peptidomimetic macrocycle disclosed herein is used for manufacture of a medicament for treating a disease or condition in a subject in need thereof.

In one aspect, the present invention provides novel peptidomimetic macrocycles that are useful in competitive binding assays to identify agents which bind to a natural ligand of the proteins or peptides upon which the peptidomimetic macrocycles are modeled. For example, labeled peptidomimetic macrocycles based on BIM can be used in a binding assay along with small molecules that competitively bind to MCL-1. Competitive binding studies allow for rapid in vitro evaluation and determination of drug candidates specific the BIM/MCL-1 interaction. Such binding studies may be performed with any of the peptidomimetic macrocycles disclosed herein and their binding partners.

The invention further provides for the generation of antibodies against the peptidomimetic macrocycles. In some embodiments, these antibodies specifically bind both the peptidomimetic macrocycle and the precursor peptides, such as BIM, to which the peptidomimetic macrocycles are related. Such antibodies, for example, disrupt the native protein-protein interactions, for example, between BIM and MCL-1.

In another aspect, the present invention provides methods to inhibit MCL-1, thereby stimulating death of a cell or tissue. In some embodiments, a subject suffering from a condition of suppressed cell death, such as B-cell lymphoma, is treated using pharmaceutical compositions of the invention.

In yet another aspect, the present invention provides methods for treating a disease driven by over-expression of MCL-1. In some embodiments, the disease driven by over-expression is a cancer. The cancer can be a liquid cancer or a solid cancer. Non-limiting examples of a liquid cancer include leukemia, lymphoma, myeloma, and myeloid dysplasia. Non-limiting examples of a solid cancer include lung cancer, breast cancer, colon cancer, brain cancer, liver cancer, soft-tissue sarcoma, pancreatic cancer, and melanoma. In some embodiments, the cancer is resistant, non-responsive, or determined unlikely to respond to a BCL-2 inhibitor. In some embodiments, the BCL-2 inhibitor is a BH3 mimetic. In some embodiments, the BCL-2 inhibitor is navitoclax (ABT-263) or obatoclax (GX15-070). These methods comprise administering an effective amount of a compound of the invention to a warm blooded animal, including a human. In some embodiments, a pharmaceutical composition provided herein used in the treatment of an MCL-1 over-expressing cancer is administered no more frequently than once daily, no more frequently than every other day, no more frequently than twice weekly, no more frequently than weekly, or no more frequently than every other week.

In some embodiments, provided herein are methods for treating neurodegenerative disorders. Many neurodegenerative diseases are a result of neurodegenerative processes including progressive loss of structure or function of neurons. These methods comprise administering an effective amount of at least one peptidomimetic macrocycles of the invention or a pharmaceutical composition thereof to a warm blooded animal, including a human. Non limiting neurodegenerative disorders that may be treated by the methods of the present invention include Parkinson's disease, Alzheimer's, Amyotrophic lateral sclerosis (ALS) and Huntington's disease.

In some embodiments, provided herein are methods for treating cardiac disorders. These methods comprise administering an effective amount of at least one peptidomimetic macrocycles of the invention or a pharmaceutical composition thereof to a warm blooded animal, including a human. Non limiting examples of cardiac disorders that may be treated by the methods of the present invention include coronary heart disease (also known as isohaemic heart disease or coronary artery disease), cardiomyopathy (diseases of cardiac muscle), hypertensive heart disease (diseases of the heart secondary to high blood pressure), heart failure, cor pulmonale (failure of the right side of the heart), cardiac dysrhythmias (abnormalities of heart rhythm), inflammatory heart disease, endocarditis (inflammation of the inner layer of the heart, the endocardium), inflammatory cardiomegaly, myocarditis (inflammation of the myocardium, the muscular part of the heart), valvular heart disease, cerebrovascular disease (disease of blood vessels that supplies to the brain such as stroke), peripheral arterial disease (disease of blood vessels that supplies to the arms and legs), congenital heart disease, and rheumatic heart disease. In some embodiments, the methods of the present invention may be used for the treatment of acute myocardial infarction or chromic ischemic heart disease.

Also provided herein are methods for promoting cardiac regeneration in a subject in need thereof. These methods comprise administering an effective amount of at least one peptidomimetic macrocycles of the invention or a pharmaceutical composition thereof to a warm blooded animal, including a human.

In some embodiments, provided herein are methods for treating diabetes or diabetes mellitus. Diabetes is a group of metabolic diseases in which a person has high blood sugar, either because the pancreas does not produce enough insulin, or because cells do not respond to the insulin that is produced. The diabetes may be Type 1 diabetes mellitus, type 2 diabetes, gestational diabetes, congenital diabetes, cystic fibrosis-related diabetes or several forms of monogenic diabetes. Treatment of diabetes may be by islet/beta cell transplantation.

In another aspect the invention provides methods of treating a subject by administering to the subject a beta cell, wherein the beta cell has been treated with an effective amount of a peptidomimetic macrocycle of the invention or a pharmaceutical composition thereof. Similarly, In another aspect the invention provides methods of treating a subject by administering to the subject a islet cell, wherein the islet cell has been treated with an effective amount of a peptidomimetic macrocycle of the invention or a pharmaceutical composition thereof.

In some embodiments, provided herein are methods for treating cancer. These methods comprise administering an effective amount of at least one peptidomimetic macrocycles of the invention or a pharmaceutical composition thereof to a warm blooded animal, including a human. Non-limiting examples of cancers that may be treated by the methods of the present invention include breast cancer such as a ductal carcinoma in duct tissue in a mammary gland, medullary carcinomas, colloid carcinomas, tubular carcinomas, and inflammatory breast cancer; ovarian cancer, including epithelial ovarian tumors such as adenocarcinoma in the ovary and an adenocarcinoma that has migrated from the ovary into the abdominal cavity; uterine cancer; cervical cancer such as adenocarcinoma in the cervix epithelial including squamous cell carcinoma and adenocarcinomas; prostate cancer, such as a prostate cancer selected from the following: an adenocarcinoma or an adenocarinoma that has migrated to the bone; pancreatic cancer such as epitheliod carcinoma in the pancreatic duct tissue and an adenocarcinoma in a pancreatic duct; bladder cancer such as a transitional cell carcinoma in urinary bladder, urothelial carcinomas (transitional cell carcinomas), tumors in the urothelial cells that line the bladder, squamous cell carcinomas, adenocarcinomas, and small cell cancers; leukemia such as acute myeloid leukemia (AML), acute lymphocytic leukemia, chronic lymphocytic leukemia, chronic myeloid leukemia, hairy cell leukemia, myelodysplasia, myeloproliferative disorders, acute myelogenous leukemia (AML), chronic myelogenous leukemia (CML), mastocytosis, chronic lymphocytic leukemia (CLL), multiple myeloma (MM), and myelodysplastic syndrome (MDS); bone cancer; lung cancer such as non-small cell lung cancer (NSCLC), which is divided into squamous cell carcinomas, adenocarcinomas, and large cell undifferentiated carcinomas, and small cell lung cancer; skin cancer such as basal cell carcinoma, melanoma, squamous cell carcinoma and actinic keratosis, which is a skin condition that sometimes develops into squamous cell carcinoma; eye retinoblastoma; cutaneous or intraocular (eye) melanoma; primary liver cancer (cancer that begins in the liver); kidney cancer; thyroid cancer such as papillary, follicular, medullary and anaplastic; AIDS-related lymphoma such as diffuse large B-cell lymphoma, B-cell immunoblastic lymphoma and small non-cleaved cell lymphoma; Kaposi's Sarcoma; viral-induced cancers including hepatitis B virus (HBV), hepatitis C virus (HCV), and hepatocellular carcinoma; human lymphotropic virus-type 1 (HTLV-1) and adult T-cell leukemia/lymphoma; and human papilloma virus (HPV) and cervical cancer; central nervous system cancers (CNS) such as primary brain tumor, which includes gliomas (astrocytoma, anaplastic astrocytoma, or glioblastoma multiforme), Oligodendroglioma, Ependymoma, Meningioma, Lymphoma, Schwannoma, and Medulloblastoma; peripheral nervous system (PNS) cancers such as acoustic neuromas and malignant peripheral nerve sheath tumor (MPNST) including neurofibromas and schwannomas, malignant fibrous cytoma, malignant fibrous histiocytoma, malignant meningioma, malignant mesothelioma, and malignant mixed Müllerian tumor; oral cavity and oropharyngeal cancer such as, hypopharyngeal cancer, laryngeal cancer, nasopharyngeal cancer, and oropharyngeal cancer; stomach cancer such as lymphomas, gastric stromal tumors, and carcinoid tumors; testicular cancer such as germ cell tumors (GCTs), which include seminomas and nonseminomas, and gonadal stromal tumors, which include Leydig cell tumors and Sertoli cell tumors; thymus cancer such as to thymomas, thymic carcinomas, Hodgkin disease, non-Hodgkin lymphomas carcinoids or carcinoid tumors; rectal cancer; and colon cancer.

In some embodiments, a peptidomimetic macrocycle disclosed herein is administered in combination with an additional therapy to treat a cancer. Non-limiting examples of the additional therapy include surgery, radiation therapy, chemotherapy, or immunotherapy. In some embodiments, the combination of the peptidomimetic macrocycle and surgery is on an adjuvant basis or a neo-adjuvant basis.

Non-limiting examples of chemotherapy include alkylating agents, angiogenesis inhibitors, antimetabolites, Bcr-Abl kinase inhibitors, cyclin-dependent kinase inhibitors, cyclooxygenase-2 inhibitors, epidermal growth factor receptor (EGFR) inhibitors, leukemia viral oncogene homolog (ErbB2) receptor inhibitors, histone deacetylase (HDAC) inhibitors, heat shock protein (HSP)-90 inhibitors, inhibitors of inhibitors of apoptosis proteins (IAPs), antibody drug conjugates, activators of death receptor pathway, kinesin inhibitors, JAK-2 inhibitors, mitogen-activated extracellular signal-regulated kinase (MEK) inhibitors, mammalian target of rapamycin (mTOR) inhibitors, non-steroidal anti-inflammatory drugs (NSAIDs), platelet-derived growth factor receptor (PDGFR) inhibitors, platinum chemotherapeutics, polo-like kinase (Plk) inhibitors, phosphoinositide-3 kinase (PI3K) inhibitors, thrombospondin analogs, vascular endothelial growth factor receptor (VEGFR) inhibitors, intercalating antibiotics, topoisomerase inhibitors, antibodies, hormonal therapies, deltoids and retinoids, poly ADP (adenosine diphosphate)-ribose polymerase (PARP) inhibitors, plant alkaloids, proteasome inhibitors, biologic response modifiers, pyrimidine analogs, purine analogs, antimitotics, taxanes, and ubiquitin ligase inhibitors.

Non-limiting examples of alkylating agents include: altretamine, AMD-473, AP-5280, apaziquone, bendamustine, brostallicin, busulfan, carboquone, carmustine, chlorambucil, laromustine, cyclophosphamide, decarbazine, estramustine, fotemustine, glufosfamide, ifosfamide, KW-2170, lomustine, mafosfamide, melphalan, mitobronitol, mitolactol, nimustine, nitrogen mustard N-oxide, ranimustine, temozolomide, thiotepa, bendamustine, treosulfan, and rofosfamide.

Non-limiting examples of angiogenesis inhibitors include: endothelial-specific receptor tyrosine kinase (Tie-2) inhibitors, epidermal growth factor receptor (EGFR) inhibitors, insulin growth factor-2 receptor (IGFR-2) inhibitors, matrix metalloproteinase-2 (MMP-2) inhibitors, matrix metalloproteinase-9 (MMP-9) inhibitors, platelet-derived growth factor receptor (PDGFR) inhibitors, thrombospondin analogs, and vascular endothelial growth factor receptor tyrosine kinase (VEGFR) inhibitors.

Non-limiting examples of antimetabolites include: pemetrexed disodium, 5-azacitidine, capecitabine, carmofur, cladribine, clofarabine, cytarabine, cytarabine ocfosfate, cytosine arabinoside, decitabine, deferoxamine, doxifluridine, eflornithine, EICAR, enocitabine, ethnylcytidine, fludarabine, 5-fluorouracil, leucovorin, gemcitabine, hydroxyurea, melphalan, mercaptopurine, 6-mercaptopurine riboside, methotrexate, mycophenolic acid, nelarabine, nolatrexed, ocfosfate, pelitrexol, pentostatin, raltitrexed, Ribavirin, triapine, trimetrexate, S-1, tiazofurin, tegafur, TS-1, vidarabine, and UFT.

Non-limiting examples of Bcr-Abl kinase inhibitors include: dasatinib, nilotinib, and imatinib.

Non-limiting examples of CDK inhibitors include: AZD-5438, BMI-1040, BMS-032, BMS-387, CVT-2584, flavopyridol, GPC-286199, MCS-5A, PD0332991, PHA-690509, seliciclib, and ZK-304709.

Non-limiting examples of COX-2 inhibitors include: ABT-963, etoricoxib, valdecoxib, BMS347070, celecoxib, lumiracoxib, CT-3, deracoxib, JTE-522, 4-methyl-2-(3,4-dimethylphenyl)-1-(4-sulfamoylphenyl-1H-pyrrole), etoricoxib, NS-398, parecoxib, RS-57067, SC-58125, SD-8381, SVT-2016, S-2474, T-614, and rofecoxib.

Non-limiting examples of EGFR inhibitors include: ABX-EGF, anti-EGFR immunoliposomes, EGF-vaccine, EMD-7200, cetuximab, HR3, IgA antibodies, gefitinib, erlotinib, TP-38, EGFR fusion protein, and lapatinib.

Non-limiting examples of ErbB2 receptor inhibitors include: CP-724-714, canertinib, trastuzumab, lapatinib, petuzumab, TAK-165, ionafarnib, GW-282974, EKB-569, PI-166, dHER2 HER2 vaccine, APC-8024 HER-2 vaccine, anti-HER2/neu bispecific antibody, B7.her21gG3, AS HER2 trifunctional bispecific antibodies, mAB AR-209, and mAB 2B-1.

Non-limiting examples of histone deacetylase inhibitors include: depsipeptide, LAQ-824, MS-275, trapoxin, suberoylanilide hydroxamic acid (SAHA), TSA, and valproic acid.

Non-limiting examples of HSP-90 inhibitors include: 17-AAG-nab, 17-AAG, CNF-101, CNF-1010, CNF-2024, 17-DMAG, geldanamycin, IPI-504, KOS-953, human recombinant antibody to HSP-90, NCS-683664, PU24FC1, PU-3, radicicol, SNX-2112, or STA-9090 VER49009.

Non-limiting examples of inhibitors of inhibitors of apoptosis proteins include: HGS 1029, GDC-0145, GDC-0152, LCL-161, and LBW-242.

Non-limiting examples of antibody-drug conjugates include: anti-CD22-MC-MMAF, anti-CD22-MC-MMAE, anti-CD22-MCC-DM1, CR-0,1-vcMMAE, PSMA-ADC, MEDI-547, SGN-19Am SGN-35, and SGN-75.

Non-limiting examples of activators of death receptor pathway include: TRAIL, antibodies or other agents that target TRAIL or death receptors (e.g., DR4 and DR5) such as apomab, conatumumab, ETR2-ST01, GDC0145, lexatumumab, HGS-1029, LBY-135, PRO-1762, and trastuzumab.

Non-limiting examples of kinesin inhibitors include: Eg5 inhibitors such as AZD4877, ARRY-520; and CENPE inhibitors such as GSK923295A.

Non-limiting examples of JAK-2 inhibitors include: lesaurtinib, XL019 or INCB018424.

Non-limiting examples of MEK inhibitors include: trametinib, ARRY-142886, ARRY-438162 PD-325901, CI-1040, and PD-98059.

Non-limiting examples of mTOR inhibitors include: AP-23573, CCI-779, everolimus, RAD-001, rapamycin, temsirolimus, ATP-competitive TORC1/TORC2 inhibitors, comprising PI-103, PP242, PP30, and Torin 1.

Non-limiting examples of non-steroidal anti-inflammatory drugs include: salsalate, diflunisal, ibuprofen, ketoprofen, nabumetone, piroxicam, ibuprofen cream, naproxen, diclofenac, indomethacin, sulindac, tolmetin, etodolac, ketorolac, and oxaprozin.

Non-limiting examples of PDGFR inhibitors include: C-451, CP-673, and CP-868596.

Non-limiting examples of platinum chemotherapeutics include: cisplatin, oxaliplatin, eptaplatin, lobaplatin, nedaplatin, carboplatin, satraplatin, and picoplatin.

Non-limiting examples of polo-like kinase inhibitors include: BI-2536.

Non-limiting examples of phosphoinositide-3 kinase (PI3K) inhibitors include: wortmannin, LY294002, XL-147, CAL-120, ONC-21, AEZS-127, ETP-45658, PX-866, GDC-0941, BGT226, BEZ235, and XL765.

Non-limiting examples of thrombospondin analogs include: ABT-510, ABT-567, ABT-898, and TSP-1.

Non-limiting examples of VEGFR inhibitors include: bevacizumab, ABT-869, AEE-788, ANGIOZYME™ (a ribozyme that inhibits angiogenesis, axitinib, AZD-2171, CP-547,632, IM-862, pegaptamib, sorafenib, pazopanib, vatalanib, sunitinib, VEGF trap, and vandetanib.

Non-limiting examples of antibiotics include: intercalating antibiotics aclarubicin, actinomycin D, amrubicin, annamycin, adriamycin, bleomycin, daunorubicin, liposomal doxorubicin, doxorubicin, elsamitrucin, epirbucin, glarbuicin, idarubicin, mitomycin C, nemorubicin, neocarzinostatin, peplomycin, pirarubicin, rebeccamycin, stimalamer, streptozocin, valrubicin, and zinostatin.

Non-limiting examples of topoisomerase inhibitors include: aclarubicin, 9-aminocamptothecin, amonafide, amsacrine, becatecarin, belotecan, BN-80915, irinotecan, camptothecin, dexrazoxine, diflomotecan, edotecarin, epirubicin, etoposide, exatecan, 10-hydroxycamptothecin, gimatecan, lurtotecan, mitoxantrone, orathecin, pirarbucin, pixantrone, rubitecan, sobuzoxane, SN-38, tafluposide, and topotecan.

Non-limiting examples of antibodies include: bevacizumab, CD40 antibodies, chTNT-1/B, denosumab, cetuximab, zanolimumab, IGF1R antibodies, lintuzumab, edrecolomab, WX G250, rituximab, ticilimumab, trastuzumab, CD20 antibodies types I and II, pembrolizumab, ipilumimab, nivolumab, rituximab, and panitumumab.

Non-limiting examples of hormonal therapies include: anastrozole, exemestane, arzoxifene, bicalutamide, cetrorelix, degarelix, deslorelin, trilostane, dexamethasone, flutamide, raloxifene, fadrozole, toremifene, fulvestrant, letrozole, formestane, glucocorticoids, doxercalciferol, sevelamer carbonate, lasofoxifene, leuprolide acetate, megesteroL mifepristone, nilutamide, tamoxifen citrate, abarelix, prednisone, finasteride, rilostane, buserelin, luteinizing hormone releasing hormone (LHRH), histrelin implant, trilostane, modrastane, fosrelin, and goserelin.

Non-limiting examples of deltoids and retinoids include: seocalcitol, lexacalcitrol, fenretinide, aliretinoin, liposomal tretinoin, bexarotene, and LGD-1550.

Non-limiting examples of PARP inhibitors include: ABT-888, olaparib, KU-59436, AZD-2281, AG-014699, BSI-201, BGP-15, INO-1001, and ONO-2231.

Non-limiting examples of plant alkaloids include: vincristine, vinblastine, vindesine, and vinorelbine.

Non-limiting examples of proteasome inhibitors include: bortezomib, carfilzomib, MG 132, and NPI-0052.

Non-limiting examples of biological response modifiers include: krestin, lentinan, sizofuran, picibaniL PF-3512676, and ubenimex.

Non-limiting examples of pyrimidine analogs include: cytarabine, cytosine arabinoside, doxifluridine, fludarabine, 5-fluorouracil, floxuridine, gemcitabine, ratitrexed, and triacetyluridine troxacitabine.

Non-limiting examples of purine analogs include: thioguanine, and mercaptopurine.

Non-limiting examples of antimitotic agents include: batabulin, epothilone D, N-(2-((4-hydroxyphenyl)amino) pyridin-3-yl)-4-methoxybenzenesulfonamide, ixabepilone, paclitaxel, docetaxel, PNU100940, patupilone, XRP-9881 larotaxel, vinflunine, and epothilone.

Non-limiting examples of ubiquitin ligase inhibitors include paclitaxel and docetaxel.

Non-limiting examples of ubiquitin ligase inhibitors include: MDM2 inhibitors, such as nutlins, and NEDD8 inhibitors such as MLN4924.

Non-limiting examples of immunotherapies include: interferons or immune-enhancing agents. Interferons comprise interferon alpha, interferon alpha-2a, interferon alpha-2b, interferon beta, interferon gamma-1a, interferon gamma-1b, interferon gamma-nl, Other immune-enhancing agents comprise oxidized glutathione, tasonermin, tositumomab, alemtuzumab, CTLA4, decarbazine, denileukin, epratuzumab, lenograstim, lentinan, leukocyte alpha interferon, imiquimod, ipilumimab, melanoma vaccine, mitumomab, molgramostim, nivolumab, pembrolizumab, gemtuzumab ozogamicin, filgrastim, OncoVAC-CL, oregovomab, pemtumomab, sipuleucel-T, sargaramostim, sizofilan, teceleukin, Bacillus Calmette-Guerin, ubenimex, virulizin, Z-100, Tetrachlorodecaoxide (TCDO), aldesleukin, thymalfasin, daclizumab, and 90Y-Ibritumomab tiuxetan.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

EXAMPLES

Example 1: Peptidomimetic Macrocycles of the Invention

Peptidomimetic macrocycles were synthesized, purified and analyzed as previously described and as described below (Schafmeister et al., J. Am. Chem. Soc. 122:5891-5892 (2000); Schafmeister & Verdine, J. Am. Chem. Soc. 122:5891 (2005); Walensky et al., Science 305:1466-1470 (2004); and U.S. Pat. No. 7,192,713). Peptidomimetic macrocycles were designed by replacing two or more naturally occurring amino acids with the corresponding synthetic amino acids. Substitutions were made at i and i+4, and i and i+7 positions. Peptide synthesis was performed either manually or on an automated peptide synthesizer (Applied Biosystems, model 433A), using solid phase conditions, rink amide AM resin (Novabiochem), and Fmoc main-chain protecting group chemistry. For the coupling of natural Fmoc-protected amino acids (Novabiochem), 10 equivalents of amino acid and a 1:1:2 molar ratio of coupling reagents HBTU/HOBt (Novabiochem)/DIEA were employed. Non-natural amino acids (4 equiv) were coupled with a 1:1:2 molar ratio of HATU (Applied Biosystems)/HOBt/DIEA. The N-termini of the synthetic peptides were acetylated, while the C-termini were amidated.

Purification of cross-linked compounds was achieved by high performance liquid chromatography (HPLC) (Varian ProStar) on a reverse phase C18 column (Varian) to yield the pure compounds. Chemical composition of the pure products was confirmed by LC/MS mass spectrometry (Micromass LCT interfaced with Agilent 1100 HPLC system) and amino acid analysis (Applied Biosystems, model 420A).

Example 2: Metabolism by Purified Protease

Linear peptides and cross-linked peptidomimetic macrocycles are tested for stability to proteolysis by Trypsin (MP Biomedicals, Solon Ohio) by solubilizing each peptide at 10 µM concentration in 200 µL 100 mM NH4OAc (pH 7.5). The reaction is initiated by adding 3.5 µl of Trypsin (12.5 µg protease per 500 µL reaction) and shaking continually in sealed vials while incubating in a Room Temperature (22±2° C.). The enzyme/substrate ratio is 1:102 (w/w). After incubation times of 0, 5, 30, 60 and 135 min the reaction is stopped by addition of equal volume of 0.2% trifluoroacetic acid. Then, the solution is immediately analyzed by LC-MS in positive detection mode. The reaction half-life for each peptide is calculated in GraphPad Prism by a non-linear fit of uncalibrated MS response versus enzyme incubation time.

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | | Calc. (M+2)/2 | Found mass | EC50 (µM)* | Ki MCL-1 | Ki BCL-XL | Ki BCL-2 |
|---|---|---|---|---|---|---|---|---|---|---|---|---|---|---|---|---|---|---|---|---|---|---|---|---|---|---|---|---|
| 1626 Ac- | I | W | I | A | Q | A | L | R | $r8 | I | G | D | E | F | N | $ | Y | A | | | | -NH2 | 1344.74 | 1345.7 | | 10.6 | 3.9 | 12.9 |
| 1627 Ac- | I | W | I | A | Q | E | L | R | $r8 | I | G | D | E | F | N | $ | Y | A | A | R | R | -NH2 | 1373.75 | 1373.56 | | | 9.2 | 23.5 |
| 1628 Ac- | I | | I | A | Q | A | L | R | $r8 | I | G | D | A | F | N | $ | Y | A | A | R | | -NH2 | 1103.1 | 1103.12 | | | 212.6 | 423.8 |
| 1629 Ac- | I | W | I | A | Q | A | L | R | $r8 | I | G | D | A | F | A | $ | Y | A | | | | -NH2 | 988.55 | 988.45 | | | 373.6 | 877.5 |
| 1630 Ac- | I | | I | A | Q | A | L | R | $r8 | I | G | D | A | F | N | $ | A | A | | | | -NH2 | 964.04 | 963.94 | | | >1000 | >1000 |
| 1631 Ac- | I | W | I | A | Q | A | L | R | $r8 | I | G | D | A | F | N | $ | Y | A | | | | -NH2 | 1159.64 | 1159.87 | 6.6 | 8.4 | 22.4 | 84.8 |
| 1632 Ac- | I | W | I | A | Q | A | L | R | $r8 | I | G | D | A | F | N | $ | Y | A | | | | -NH2 | 1103.1 | 1102.9 | | | | 410.2 |
| 1633 Ac- | I | | I | A | Q | A | L | R | $r8 | I | G | D | A | F | N | $ | Y | A | | | | -NH2 | 1010.06 | 1009.9 | | | 308.6 | 519.2 |
| 1634 Ac- | I | | I | A | Q | A | L | R | $r8 | I | G | D | A | F | N | $ | Y | A | | | | -NH2 | 981.55 | 981.86 | | | 255.9 | 318.7 |
| 1635 Ac- | I | | I | A | A | A | L | A | $r8 | I | A | D | A | F | N | $ | Y | A | | | | -NH2 | 967.53 | 967.45 | | | >1000 | >1000 |
| 1636 Ac- | I | | I | A | Q | A | L | R | $r8 | I | G | D | A | F | N | $ | Y | A | | | | -NH2 | 1017.07 | 1016.93 | | | 243.1 | 272.5 |
| 1637 Ac- | I | | I | A | Q | A | L | R | $r8 | I | G | D | A | F | N | $ | Y | A | | | | -NH2 | 972.04 | 971.89 | | | >1000 | >1000 |
| 1638 Ac- | I | | I | A | Q | A | L | R | $r8 | I | G | D | A | F | N | $ | Y | A | | | | -NH2 | 964.04 | 963.94 | | | 471.5 | 803.9 |
| 1639 Ac- | I | $ | I | A | Q | $ | L | R | $r8 | I | G | D | E | F | N | $ | Y | A | | | | -NH2 | 1185.17 | 1185.61 | >40 | 19.5 | 11.6 | 8.7 |
| 1640 Ac- | I | W | I | A | Q | A | L | R | $r8 | I | G | D | A | F | N | % | Y | A | | | | -NH2 | 1160.14 | 1161.28 | | | | |
| 1641 Ac- | I | W | I | A | Q | A | L | R | $r8 | I | G | D | A | F | A | $ | Y | A | | | | -NH2 | 1167.14 | 1168.2 | | 7.0 | 15.4 | 21.9 |
| 1642 Ac- | I | W | I | A | Q | A | L | R | $r8 | I | G | D | A | F | N | $ | A | A | | | | -NH2 | 1150.13 | 1151.09 | | | | |
| 1643 FITC-Ba | I | W | I | A | Q | A | L | R | $r8 | I | G | D | E | F | N | $ | Y | A | | | | -NH2 | 1368.67 | 1369.79 | | ND | ND | ND |
| 1644 5-FAMBa | I | W | I | A | Q | A | L | R | $r8 | I | G | D | A | F | N | $ | Y | A | | | | -NH2 | 1353.18 | 1354.13 | | ND | ND | ND |
| 1645 5-FAMBa | I | W | I | A | Q | A | L | R | $r8 | I | G | D | E | F | N | $ | Y | A | | | | -NH2 | 1382.18 | 1382.99 | | ND | ND | ND |
| 1646 Ac- | I | W | I | A | Q | A | L | R | $r8 | I | G | D | E | F | N | $ | Y | A | | | | -NH2 | 1102.12 | 1103.17 | | 19.7 | 22.3 | 37.7 |
| 1647 Ac- | I | W | I | A | Q | A | L | R | $r8 | I | G | D | E | F | N | $ | Y | A | | | | -NH2 | 1188.64 | 1189.57 | >40 | 1.8 | 1.4 | 3.2 |
| 1648 Ac- | I | W | I | A | Q | A | L | R | $r8 | I | G | D | Q | F | N | $ | Y | A | | | | -NH2 | 1188.15 | 1189.1 | | 5.2 | 12.0 | 67.0 |
| 1649 Ac- | I | W | I | A | Q | A | L | R | $r8 | I | G | D | E | F | N | $ | Y | A | | | | -NH2 | 1160.13 | 1161.17 | | 1.0 | 1.0 | 6.0 |

-continued

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | | Calc. (M+2)/2 | Found mass | EC$_{50}$ (μM)* | KI MCL-1 | KI BCL-X$_L$ | KI BCL-2 |
|---|---|---|---|---|---|---|---|---|---|---|---|---|---|---|---|---|---|---|---|---|---|---|---|---|---|---|---|---|
| 1650 | Ac- | I | W | I | A | A | A | L | R | $r8I | G | D | Q | F | N | S | Y | Y | A | | | -NH$_2$ | 1159.64 | 1160.34 | | 6.0 | 4.0 | 22.0 |
| 1651 | Ac- | I | W | I | A | A | A | L | R | $r8I | G | D | A | F | N | S | Y | Y | A | | | -NH$_2$ | 1131.13 | 1132.12 | | 6.7 | 25.6 | 65.4 |
| 1652 | Ac- | I | W | I | A | A | A | L | R | $r8I | G | D | A | F | A | S | Y | Y | A | | | -NH$_2$ | 1138.14 | 1139.15 | | 7.4 | 55.7 | 114.6 |
| 1653 | Ac- | I | W | I | A | Q | A | L | Cit | $r8I | G | D | A | F | N | S | Y | Y | A | | | -NH$_2$ | 1160.13 | 1160.98 | 9.1 | 7.5 | 109.0 | 211.6 |
| 1654 | Ac- | I | W | I | A | Q | A | L | Cit | $r8I | G | D | Q | F | N | S | Y | Y | A | | | -NH$_2$ | 1188.64 | 1189.66 | | 1.7 | 28.8 | 88.2 |
| 1655 | Ac- | I | W | I | A | Q | A | L | H | $r8I | G | D | A | F | N | S | Y | Y | A | | | -NH$_2$ | 1150.12 | 1151.09 | | >100 | >100 | >100 |
| 1656 | Ac- | I | W | I | A | Q | A | L | H | $r8I | G | D | Q | F | N | S | Y | Y | A | | | -NH$_2$ | 1178.63 | 1179.67 | | >100 | >100 | >100 |
| 1657 | Ac- | I | W | I | A | Q | A | L | Q | $r8I | G | D | A | F | N | S | Y | Y | A | | | -NH$_2$ | 1145.62 | 1146.55 | | 76.2 | 325.4 | 364.7 |
| 1658 | Ac- | I | W | I | A | Q | A | L | Q | $r8I | G | D | Q | F | N | S | Y | Y | A | | | -NH$_2$ | 1174.13 | 1175.14 | | 14.8 | 6.3 | 27.5 |
| 1659 | Ac- | I | W | I | A | Q | A | L | R | $r8I | G | D | A | A | N | S | Y | Y | A | | | -NH$_2$ | 1121.62 | 1122.5 | | 7.5 | 401.7 | 139.7 |
| 1660 | Ac- | I | W | I | A | Q | A | L | R | $r8I | G | D | A | I | N | S | Y | Y | A | | | -NH$_2$ | 1142.65 | 1143.59 | | 3.4 | 14.1 | 113.0 |
| 1661 | Ac- | I | W | I | A | Q | A | L | R | $r8I | G | D | Q | I | N | S | Y | Y | A | | | -NH$_2$ | 1171.16 | 1171.9 | | | | |
| 1662 | Ac- | I | W | I | A | Q | A | A | R | $r8A | A | D | Q | A | N | S | Y | Y | A | | | -NH$_2$ | 1100.6 | 1101.5 | | 177.0 | 154.0 | 502.0 |
| 1663 | Ac- | I | W | I | A | Q | A | L | R | $r8F | A | D | Q | F | N | S | Y | Y | A | | | -NH$_2$ | 1166.65 | 1167.83 | | 96.3 | 7.7 | 84.0 |
| 1664 | Ac- | I | W | I | A | Q | A | L | R | $r8I | G | D | Q | F | N | S | Y | Y | A | | | -NH$_2$ | 1195.16 | 1196.23 | | 2 | 7.7 | 25.6 |
| 1665 | Ac- | I | W | I | A | Q | A | L | R | $r8I | G | D | A | F | N | S | Y | Y | A | | | -NH$_2$ | 1138.62 | 1139.61 | | 7 | 18.1 | 59.6 |
| 1666 | Ac- | I | W | I | A | Q | A | L | R | $r8I | G | D | Q | F | N | S | Y | Y | A | | | -NH$_2$ | 1167.13 | 1168.11 | | 122 | 1.9 | 4.8 |
| 1667 | Ac- | I | W | I | A | Q | A | L | R | $r8I | G | D | Q | F | N | S | Y | Y | A | | | -NH$_2$ | 1176.63 | 1177.63 | | 27.8 | 15.8 | 68.5 |
| 1668 | Ac- | I | W | I | A | Q | A | L | R | $r8I | G | D | Q | F | N | S | Y | Y | A | | | -NH$_2$ | 1205.14 | 1205.94 | | 74.1 | 25.6 | 66.1 |
| 1669 | Ac- | I | W | F | A | Q | A | L | R | $r8I | G | D | Q | F | N | S | Y | Y | A | | | -NH$_2$ | 1176.63 | 1177.63 | | 22.0 | 28.0 | 179.4 |
| 1670 | Ac- | I | W | F | A | Q | A | L | R | $r8I | G | D | Q | F | N | S | Y | Y | A | | | -NH$_2$ | 1205.14 | 1206.13 | | 29.3 | 25.9 | 204.6 |
| 1671 | Ac- | I | W | I | A | Q | A | L | R | $r8I | G | N | A | F | N | S | Y | Y | A | | | -NH$_2$ | 1117.11 | 1118.15 | | 73.8 | 386.4 | |
| 1672 | Ac- | I | W | I | A | Q | A | L | R | $r8I | G | D | A | F | N | S | Y | Y | A | | | -NH$_2$ | 1159.15 | 1159.63 | | 416.0 | 404.9 | |
| 1673 | Ac- | I | W | I | A | Q | A | L | R | $r8I | G | D | A | F | N | S | Y | Y | A | | | -NH$_2$ | 1138.62 | 1139.2 | | >100 | >100 | >100 |
| 1674 | Ac- | I | W | I | A | Q | A | L | R | $r8I | G | D | Q | F | A | S | Y | Y | A | | | -NH$_2$ | 1166.65 | 1167.3 | | 22.8 | 53.5 | 84.9 |

-continued

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | Calc. (M + 2)/2 | Found mass | EC$_{50}$ (µM)* | KI MCL-1 | KI BCL-X$_L$ | KI BCL-2 |
|---|---|---|---|---|---|---|---|---|---|---|---|---|---|---|---|---|---|---|---|---|---|---|---|---|---|---|---|
| 1675 Ac- | I | W | Cha | A | Q | A | L | R | $r8 | I | G | D | A | F | N | $ | Y | A | | | -NH$_2$ | 1179.65 | 1180.15 | 3.9 | 43.8 | 14.4 | 104.9 |
| 1676 Ac- | I | W | hhL | A | Q | A | L | R | $r8 | I | G | D | A | F | N | $ | Y | A | | | -NH$_2$ | 1173.65 | 1174.39 | 5.7 | 21.2 | 11.9 | 160.7 |
| 1677 Ac- | I | W | Adm | A | Q | A | L | R | $r8 | I | G | D | A | F | N | $ | Y | A | | | -NH$_2$ | 1198.66 | 1199.28 | | 21.6 | 7.3 | 59.0 |
| 1678 Ac- | I | W | hCha | A | Q | A | L | R | $r8 | I | G | D | A | F | N | $ | Y | A | | | -NH$_2$ | 1186.66 | 1186.98 | 7.2 | 22.2 | 13.1 | 182.3 |
| 1679 Ac- | I | W | hF | A | Q | A | L | R | $r8 | I | G | D | A | F | N | $ | Y | A | | | -NH$_2$ | 1183.64 | 1184.48 | 5.9 | 53.1 | 69.7 | 221.2 |
| 1680 Ac- | I | W | Igl | A | Q | A | L | R | $r8 | I | G | D | A | F | N | $ | Y | A | | | -NH$_2$ | 1190.65 | 1190.41 | | 12.8 | 145.5 | 246.4 |
| 1681 Ac- | I | W | F4CF3A | A | Q | A | L | R | $r8 | I | G | D | A | F | N | $ | Y | A | | | -NH$_2$ | 1210.62 | 1211.31 | | 76.7 | 9.1 | 237.0 |
| 1682 Ac- | I | W | F4tBuA | A | Q | A | L | R | $r8 | I | G | D | A | F | N | $ | Y | A | | | -NH$_2$ | 1204.66 | 1205.39 | 4.8 | 150.8 | 16.9 | >1000 |
| 1683 Ac- | I | W | 2Nal | A | Q | A | L | R | $r8 | I | G | D | A | F | N | $ | Y | A | | | -NH$_2$ | 1201.64 | 1202.2 | 6.4 | 163.2 | 151.1 | 264.6 |
| 1684 Ac- | I | W | Bip | A | Q | A | L | R | $r8 | I | G | D | A | F | N | $ | Y | A | | | -NH$_2$ | 1214.65 | 1215.43 | | 11.0 | 3.0 | >1000 |
| 1685 Ac- | I | W | I | A | Q | A | Cha | R | $r8 | I | G | D | A | F | N | $ | Y | A | | | -NH$_2$ | 1179.65 | 1180.22 | | 4.2 | 81.1 | >1000 |
| 1686 Ac- | I | W | I | A | Q | A | hhL | R | $r8 | I | G | D | A | F | N | $ | Y | A | | | -NH$_2$ | 1173.65 | 1174.4 | | 3.1 | 135.9 | 231.4 |
| 1687 Ac- | I | W | I | A | Q | A | Adm | R | $r8 | I | G | D | A | F | N | $ | Y | A | | | -NH$_2$ | 1198.66 | 1199.05 | 0.5 | 40.2 | 109.5 | >1000 |
| 1688 Ac- | I | W | I | A | Q | A | hCha | R | $r8 | I | G | D | A | F | N | $ | Y | A | | | -NH$_2$ | 1186.66 | 1187.25 | | 3.8 | >1000 | >1000 |
| 1689 Ac- | I | W | I | A | Q | A | hAdm | R | $r8 | I | G | D | A | F | N | $ | Y | A | | | -NH$_2$ | 1205.67 | 1206.4 | | 16.6 | >1000 | 240.3 |
| 1690 Ac- | I | W | I | A | Q | A | hF | R | $r8 | I | G | D | A | F | N | $ | Y | A | | | -NH$_2$ | 1183.64 | 1184.29 | | 7.5 | >1000 | >1000 |
| 1691 Ac- | I | W | I | A | Q | A | Igl | R | $r8 | I | G | D | A | F | N | $ | Y | A | | | -NH$_2$ | 1190.65 | 1190.4 | | 47.7 | 146.7 | >1000 |
| 1692 Ac- | I | W | I | A | Q | A | F4CF3R | R | $r8 | I | G | D | A | F | N | $ | Y | A | | | -NH$_2$ | 1210.62 | 1210.94 | | 188.1 | 10.8 | >1000 |
| 1693 Ac- | I | W | I | A | Q | A | F4tBuR | R | $r8 | I | G | D | A | F | N | $ | Y | A | | | -NH$_2$ | 1204.66 | 1205.29 | | 169.0 | 12.7 | 288.0 |
| 1694 Ac- | I | W | I | A | Q | A | 2Nal | R | $r8 | I | G | D | A | F | N | $ | Y | A | | | -NH$_2$ | 1201.64 | 1202.15 | | 119. | 17.3 | 234.4 |
| 1695 Ac- | I | W | I | A | Q | A | Bip | R | $r8 | I | G | D | A | F | N | $ | Y | A | | | -NH$_2$ | 1214.65 | 1214.91 | | 83.7 | 8.0 | 280.1 |
| 1696 Ac- | I | W | I | A | Q | A | L | R | $r8 CbuG | I | G | D | A | F | N | $ | Y | A | | | -NH$_2$ | 1165.64 | 1166.07 | | 26.6 | 27.5 | 89.0 |
| 1697 Ac- | I | W | I | A | Q | A | L | R | $r8 hL | I | G | D | A | F | N | $ | Y | A | | | -NH$_2$ | 1166.65 | 1167.37 | | 13.0 | 6.0 | 12.7 |
| 1698 Ac- | I | W | I | A | Q | A | L | R | $r8 ChaG | I | G | D | A | F | N | $ | Y | A | | | -NH$_2$ | 1179.65 | 1180.22 | | 15.9 | 7.1 | 109.1 |

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | Calc. (M + 2)/2 | Found mass | EC$_{50}$ (μM) * | KI MCL-1 | KI BCL-X$_L$ | KI BCL-2 |
|---|---|---|---|---|---|---|---|---|---|---|---|---|---|---|---|---|---|---|---|---|---|---|---|---|---|---|---|
| 1699 Ac- | I | W | I | A | Q | A | L | R | $r8 | TbaG | D | A | F | N | $ | Y | A | -NH$_2$ | | | | 1166.65 | 1167.18 | | 13.7 | 35.4 | 227.1 |
| 1700 Ac- | I | W | I | A | Q | A | L | R | $r8 | hhLG | D | A | F | N | $ | Y | A | -NH$_2$ | | | | 1173.65 | 1173.93 | | 34.6 | 4.0 | 23.1 |
| 1701 Ac- | I | AmW | I | A | Q | A | L | R | $r8 | I | G | D | A | F | N | $ | Y | A | -NH$_2$ | | | | 1166.65 | 1167.18 | | 9.9 | 17.4 | 70.6 |
| 1702 Ac- | I | Aib | I | A | Q | A | L | R | $r8 | I | G | D | A | F | N | $ | Y | A | -NH$_2$ | | | | 1109.13 | 1109.46 | | 42.5 | 83.5 | 97.9 |
| 1703 Ac- | AmL | W | I | A | Q | A | L | R | $r8 | I | G | D | A | F | N | $ | Y | A | -NH$_2$ | | | | 1166.65 | 1167.27 | | 5.2 | 8.4 | 48.3 |
| 1704 Ac- | I | W | AmL | A | Q | A | L | R | $r8 | I | G | D | A | F | N | $ | Y | A | -NH$_2$ | | | | 1137.65 | 1137.37 | | 19.8 | 7.2 | 24.8 |
| 1705 Ac- | I | W | I | Aib | Q | A | L | R | $r8 | I | G | AmD | A | F | N | $ | Y | A | -NH$_2$ | | | | 1173.65 | 1173.93 | | >1000 | >1000 | >1000 |
| 1706 Ac- | I | W | I | A | AibQ | A | L | R | $r8 | I | G | D | A | F | N | $ | Y | A | -NH$_2$ | | | | 1138.14 | 1138.32 | | 5.5 | 59.0 | 120.1 |
| 1707 Ac- | I | W | I | A | Q | AibA | L | R | $r8 | I | G | AmD | A | F | N | $ | Y | A | -NH$_2$ | | | | 1166.65 | 1167.37 | | >1000 | 15.5 | >1000 |
| 1708 Ac- | I | W | I | A | Q | A | L | R | $r8 | I | G | D | A | F | N | $ | F4F | A | -NH$_2$ | | | >40 | 1160.64 | 1161.45 | 2.1 | 4.8 | 9.5 | 91.8 |
| 1709 Ac- | I | W | Tba | A | Q | A | L | R | $r8 | I | G | D | A | F | N | $ | Y | A | -NH$_2$ | | | | 1166.65 | 1167.37 | | 10.9 | 17.2 | 36.6 |
| 1710 Ac- | I | W | hL | A | Q | A | L | R | $r8 | I | G | D | A | F | N | $ | Y | A | -NH$_2$ | | | | 1166.65 | 1167.37 | | 3.7 | 17.0 | 36.5 |
| 1711 Ac- | I | W | Chg | A | Q | A | L | R | $r8 | I | G | D | A | F | N | $ | Y | A | -NH$_2$ | | | | 1172.65 | 1173.47 | | 4.6 | 20.9 | 38.9 |
| 1712 Ac- | I | W | Ac6c | A | Q | A | L | R | $r8 | I | G | D | A | F | N | $ | Y | A | -NH$_2$ | | | | 1165.64 | 1166.44 | | 10.4 | 7.7 | 25.7 |
| 1713 Ac- | I | W | Ac5c | A | Q | A | L | R | $r8 | I | G | D | A | F | N | $ | Y | A | -NH$_2$ | | | | 1158.63 | 1159.32 | | 8.9 | 8.4 | 68.2 |
| 1714 Ac- | E | W | I | A | A | A | L | R | $r8 | I | G | D | A | F | N | $ | Y | A | -NH$_2$ | | | | 1139.11 | 1139.52 | | 2.2 | 72.0 | 117.8 |
| 1715 Ac- | R | W | I | A | A | A | L | R | $r8 | I | G | D | A | F | N | $ | Y | A | -NH$_2$ | | | | 1152.64 | 1153.49 | | 4.5 | 32.8 | 47.8 |
| 1716 Ac- | K | W | I | A | A | A | L | R | $r8 | I | G | D | A | F | N | $ | Y | A | -NH$_2$ | | | | 1138.63 | 1138.97 | | 3.9 | 27.2 | 49.7 |
| 1717 Ac- | H | W | I | A | A | A | L | R | $r8 | I | G | D | A | F | N | $ | Y | A | -NH$_2$ | | | | 1143.12 | 1143.87 | | 3.6 | 25.2 | 52.0 |
| 1718 Ac- | S | W | I | A | A | A | L | R | $r8 | I | G | D | A | F | N | $ | Y | A | -NH$_2$ | | | | 1118.1 | 1118.8 | | 3.9 | 33.4 | 53.2 |
| 1719 Ac- | Q | W | I | A | A | A | L | R | $r8 | I | G | D | A | F | N | $ | Y | A | -NH$_2$ | | | | 1138.62 | 1139.24 | | 4.8 | 35.9 | 64.9 |
| 1720 Ac- | A | W | I | A | A | A | L | R | $r8 | I | G | D | A | F | N | $ | Y | A | -NH$_2$ | | | | 1110.1 | 1110.75 | | 3.8 | 32.6 | 63.9 |
| 1721 Ac- | AibW | | I | A | A | A | L | R | $r8 | I | G | D | A | F | N | $ | Y | A | -NH$_2$ | | | | 1117.11 | 1117.78 | | 4.0 | 20.3 | 56.0 |
| 1722 Ac- | F | W | I | A | A | A | L | R | $r8 | I | G | D | A | F | N | $ | Y | A | -NH$_2$ | | | | 1148.12 | 1148.96 | | 6.2 | 33.9 | 76.7 |
| 1723 Ac- | I | D | I | A | A | A | L | R | $r8 | I | G | D | A | F | N | $ | Y | A | -NH$_2$ | | | | 1095.6 | 1096.32 | | 3.0 | 36.3 | 41.1 |

-continued

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | Calc. (M+2)/2 | Found mass | EC$_{50}$ (μM)* | KI MCL-1 | KI BCL-X$_L$ | KI BCL-2 |
|---|---|---|---|---|---|---|---|---|---|---|---|---|---|---|---|---|---|---|---|---|---|---|---|---|---|---|---|
| 1724 Ac- | I | R | I | A | A | A | L | R | $r8 | I | G | D | A | F | N | $ | Y | | A | | -NH$_2$ | 1116.14 | 1116.95 | | 9.8 | 20.5 | 39.1 |
| 1725 Ac- | I | H | I | A | A | A | L | R | $r8 | I | G | D | A | F | N | $ | Y | | A | | -NH$_2$ | 1106.62 | 1107.24 | | 6.6 | 19.5 | 43.0 |
| 1726 Ac- | I | S | I | A | A | A | L | R | $r8 | I | G | D | A | F | N | $ | Y | | A | | -NH$_2$ | 1081.6 | 1181.98 | | 15.3 | 56.2 | 89.5 |
| 1727 Ac- | I | N | I | A | A | A | L | R | $r8 | I | G | D | A | F | N | $ | Y | | A | | -NH$_2$ | 1095.11 | 1095.58 | | 11.2 | 37.3 | 62.5 |
| 1728 Ac- | I | L | I | A | A | A | L | R | $r8 | I | G | D | A | F | N | $ | Y | | A | | -NH$_2$ | 1094.63 | 1095.3 | | 10.2 | 71.8 | 125.6 |
| 1729 Ac- | I | F | I | A | A | A | L | R | $r8 | I | G | D | A | F | N | $ | Y | | A | | -NH$_2$ | 1111.62 | 1112.33 | | 10.2 | 45.3 | 95.9 |
| 1730 Ac- | I | 2Nal | I | S | A | A | L | R | $r8 | I | G | D | A | F | N | $ | Y | | A | | -NH$_2$ | 1136.63 | 1137.3 | | 13.7 | 55.3 | 144.3 |
| 1731 Ac- | I | W | I | L | A | A | L | R | $r8 | I | G | D | A | F | N | $ | Y | | A | | -NH$_2$ | 1139.13 | 1139.89 | | 3.6 | 67.8 | 117.2 |
| 1732 Ac- | I | W | I | F | A | A | L | R | $r8 | I | G | D | A | F | N | $ | Y | | A | | -NH$_2$ | 1152.15 | 1152.94 | | 19.7 | 96.2 | 170.5 |
| 1733 Ac- | I | W | I | A | L | A | L | R | $r8 | I | G | D | A | F | N | $ | Y | | A | | -NH$_2$ | 1169.14 | 1169.86 | | 17.2 | 109.9 | 125.0 |
| 1734 Ac- | I | W | I | A | A | A | L | K | $r8 | I | G | AbuD | A | F | N | $ | Y | | A | | -NH$_2$ | 1152.15 | 1152.84 | | 11.6 | 37.9 | 75.8 |
| 1735 Ac- | I | W | I | A | A | A | L | R | $r8 | I | G | D | A | F | N | $ | Y | | A | | -NH$_2$ | 1117.13 | 1117.97 | | 23.2 | 11.7 | 25.6 |
| 1736 Ac- | I | W | I | A | A | A | L | R | $r8 | I | V | D | A | F | N | $ | Y | | A | | -NH$_2$ | 1145.14 | 1145.9 | | 106.2 | 112.2 | 130.6 |
| 1737 Ac- | I | W | I | A | A | A | L | R | $r8 | I | G | E | A | F | N | $ | Y | | A | | -NH$_2$ | 1152.15 | 1152.94 | | 104.3 | 139.5 | 119.8 |
| 1738 Ac- | I | W | I | A | A | A | L | R | $r8 | I | G | D | A | G | N | $ | Y | | A | | -NH$_2$ | 1138.14 | 1138.87 | | 63.6 | 135.4 | 141.9 |
| 1739 Ac- | I | W | I | A | Q | A | L | R | $r8 | I | G | D | A | W | N | $ | Y | | A | | -NH$_2$ | 1086.1 | 1086.89 | | 29.7 | 171.4 | 145.1 |
| 1740 Ac- | I | W | I | A | A | A | L | R | $r8 | I | G | D | A | hF | N | $ | Y | | A | | -NH$_2$ | 1179.14 | 1180.04 | | 2.3 | 14.5 | 17.7 |
| 1741 Ac- | I | W | I | A | Q | A | L | R | $r8 | I | G | D | A | F4CF3N | $ | Y | | A | | -NH$_2$ | 1166.65 | 1167.46 | | 2.7 | 16.6 | 38.9 |
| 1742 Ac- | I | W | I | A | Q | A | L | R | $r8 | I | G | D | A | F4tBuN | $ | Y | | A | | -NH$_2$ | 1193.63 | 1194.38 | | 8.2 | 107.4 | 103.8 |
| 1743 Ac- | I | W | I | A | Q | A | L | R | $r8 | I | G | D | A | 2Nal | N | $ | Y | | A | | -NH$_2$ | 1187.67 | 1188.36 | | 21.2 | 154.1 | 158.3 |
| 1744 Ac- | I | W | I | A | A | A | L | R | $r8 | I | G | D | A | Bip | N | $ | Y | | A | | -NH$_2$ | 1184.65 | 1185.5 | | 4.4 | 19.1 | 35.1 |
| 1745 Ac- | I | W | I | A | A | A | L | R | $r8 | I | G | D | A | F | N | $ | Y | | A | | -NH$_2$ | 1197.65 | 1198.54 | | 6.5 | 100.2 | 113.5 |
| 1746 Ac- | I | W | I | A | A | A | L | R | $r8 | I | G | D | A | F | D | $ | Y | | A | | -NH$_2$ | 1131.62 | 1132.4 | | 1.5 | 25.9 | 35.3 |
| 1747 Ac- | I | W | I | A | A | A | L | R | $r8 | I | G | D | A | F | E | $ | Y | | A | | -NH$_2$ | 1138.63 | 1139.02 | | 1.8 | 17.9 | 30.7 |

-continued

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | Calc. (M+2)/2 | Found mass | EC$_{50}$ (μM)* | KI MCL-1 | KI BCL-X$_L$ | KI BCL-2 |
|---|---|---|---|---|---|---|---|---|---|---|---|---|---|---|---|---|---|---|---|---|---|---|---|---|---|---|---|
| 1748 Ac- | I | W | I | A | A | A | L | R | $r8 | I | G | D | A | F | Q | $ | Y | Y | A | | | 1138.14 | 1138.84 | | 4.9 | 36.5 | 71.6 |
| 1749 Ac- | I | W | I | A | A | A | L | R | $r8 | I | G | D | A | F | S | $ | Y | Y | A | | | 1117.62 | 1118.5 | | 8.0 | 44.1 | 67.5 |
| 1750 Ac- | I | W | I | A | A | A | L | R | $r8 | I | G | D | A | F | H | $ | Y | Y | A | | | 1142.64 | 1143.25 | | 8.0 | 36.3 | 57.4 |
| 1751 Ac- | I | W | I | A | A | A | L | R | $r8 | I | G | D | A | F | N | $ | Y | L | A | | | 1106.14 | 1107.05 | | 17.6 | 69.9 | 124.9 |
| 1752 Ac- | I | W | I | A | A | A | L | R | $r8 | I | G | D | A | F | N | $ | L | Y | A | | | 1113.63 | 1114.27 | | 20.3 | 51.8 | 102.0 |
| 1753 Ac- | I | W | I | A | Q | A | L | R | $r8 | I | G | D | A | F | N | $ | Y | A | A | | | 1134.65 | 1135.33 | | 23.4 | 9.0 | 18.9 |
| 1754 Ac- | I | W | I | A | Q | A | L | R | $r8 | I | G | D | A | F | N | $ | Y | L | A | | | 1154.66 | 1155.31 | | 24.1 | 8.6 | 28.9 |
| 1755 Ac- | I | W | I | A | Q | A | L | R | $r8 | I | G | D | A | F | N | $ | Y | Cha | A | | | 1158.65 | 1159.5 | | 8.0 | 12.1 | 30.7 |
| 1756 Ac- | I | W | I | A | Q | A | L | R | $r8 | I | G | D | A | F | N | $ | Y | hF | A | | | 1171.15 | 1171.78 | | 3.9 | 15.4 | 23.5 |
| 1757 Ac- | I | W | I | A | Q | A | L | R | $r8 | I | G | D | A | F | N | $ | Y | W | A | | | | 1177 | | 8.0 | 26.1 | 65.2 |
| 1758 Ac- | I | W | I | A | Q | A | L | R | $r8 | I | G | D | A | F | N | $ | Y | 2Nal | A | | | 1176.65 | | | 2.2 | 116.4 | 137.9 |
| 1759 Ac- | I | W | I | A | A | A | L | R | $r8 | I | G | D | A | F | N | $ | Y | Y | D | | | 1153.12 | 1153.77 | | 1.4 | 45.4 | 56.4 |
| 1760 Ac- | I | W | I | A | A | A | L | R | $r8 | I | G | D | A | F | N | $ | Y | Y | E | | | 1160.13 | 1160.8 | | 4.6 | 41.1 | 64.7 |
| 1761 Ac- | I | W | I | A | A | A | L | R | $r8 | I | G | D | A | F | N | $ | Y | Y | Q | | | 1159.64 | 1160.26 | | 4.7 | 36.0 | 62.4 |
| 1762 Ac- | I | W | I | A | A | A | L | R | $r8 | I | G | D | A | F | N | $ | Y | Y | S | | | 1139.13 | 1139.47 | | 10.6 | 73.8 | 98.8 |
| 1763 Ac- | I | W | I | A | A | A | L | R | $r8 | I | G | D | A | F | N | $ | Y | Y | H | | | 1164.14 | 1165.05 | | 18.5 | 185.9 | 141.8 |
| 1764 Ac- | I | W | I | A | A | A | L | R | $r8 | I | G | D | A | F | N | $ | Y | Y | R | | | 1173.66 | 1174.4 | | 6.6 | 66.3 | 43.4 |
| 1765 Ac- | I | W | I | A | A | A | L | R | $r8 | I | G | D | A | F | N | $ | Y | Y | K | | | 1159.66 | 1160.26 | 0.98 | 86.6 | >1000 | >1000 |
| 1766 Ac- | I | W | I | A | Q | A | AmL | R | $r8 | I | G | AmDA | A | F | N | $ | Y | Y | A | | | 1166.65 | 1167.18 | 15.2 | >1000 | 205.5 | >1000 |
| 1767 Ac- | I | W | I | A | Q | A | L | R | $r8 | I | G | D | A | F | N | $ | Y | Y | A | | | 1166.65 | 1167.46 | 1.4 | 14.9 | 26.0 | 199.8 |
| 1768 Ac- | I | W | I | A | Q | A | L | R | $r8 | I | G | D | A | F | N | $ | F4FY | Y | A | | | 1160.64 | 1161.26 | 4.6 | 29.0 | >1000 | 218.1 |
| 1769 Ac- | I | W | I | A | Q | A | A | R | $r8 | I | G | D | A | F | N | $ | Y | Y | Aib | | | 1166.65 | 1167.46 | 15.3 | >1000 | 85.0 | >1000 |
| 1770 Ac- | I | W | I | A | Q | A | L | Cit | $r8 | I | G | N | A | F | N | $ | Y | Y | A | | | 1139.11 | 1139.71 | 5.0 | >1000 | >1000 | >1000 |
| 1771 Ac- | I | W | I | A | Q | A | L | Cit | $r8 | I | G | D | A | A | N | $ | Y | Y | A | | | 1159.64 | 1160.4 | 19.3 | 39.5 | >1000 | >1000 |
| 1772 Ac- | I | W | I | A | Q | A | L | Cit | $r8 | I | G | D | A | V | N | $ | Y | Y | A | | | 1122.12 | 1122.87 | 5.8 | 0.8 | >1000 | >1000 |

-continued

| SEQ ID NO: | 1 | 2 | 3 | 4 | 5 | 6 | 7 | 8 | 9 | 10 | 11 | 12 | 13 | 14 | 15 | 16 | 17 | 18 | 19 | 20 | 21 | | Calc. (M + 2)/2 | Found mass | EC$_{50}$ (µM)* | KI MCL-1 | KI BCL-X$_L$ | KI BCL-2 |
|---|---|---|---|---|---|---|---|---|---|---|---|---|---|---|---|---|---|---|---|---|---|---|---|---|---|---|---|---|
| 1773 | Ac- | I | W | I | A | Q | A | L | R | $r8I | G | D | A | F | N | $ | A | Y | A | | | -NH$_2$ | 1113.63 | 1113.9 | 4.0 | 5.3 | 12.6 | 111.6 |
| 1774 | Ac- | I | W | I | A | Q | A | L | R | $r8hL | G | D | A | F | N | $ | F4F | Y | A | | | -NH$_2$ | 1167.64 | 1168.57 | 1.0 | 58.0 | 43.0 | |
| 1775 | Ac- | I | W | I | A | Q | A | L | R | $r8hL | G | D | A | F | N | $ | Y | F4F | A | | | -NH$_2$ | 1167.64 | 1168.2 | 0.7 | 27.0 | 13.0 | |
| 1776 | Ac- | I | W | I | A | Q | A | L | R | $r8hL | G | D | A | F | N | $ | F4F | F4F | A | | | -NH$_2$ | 1168.64 | 1169.59 | 0.7 | 127.0 | 121.0 | |
| 1777 | Ac- | A | W | I | A | A | A | L | R | $r8hL | G | D | A | F | N | $ | Y | F4F | A | | | -NH$_2$ | 1118.11 | 1118.89 | 0.6 | 52.0 | 37.0 | |
| 1778 | Ac- | A | W | I | A | A | A | L | R | $r8hL | G | D | A | F | N | $ | A | F4F | A | | | -NH$_2$ | 1072.1 | 1072.92 | 0.9 | 23.0 | 9.0 | |
| 1779 | Ac- | I | W | I | A | Q | A | A | R | $r8hL | G | D | A | F | N | $ | F4F | F4F | A | | | -NH$_2$ | 1147.62 | 1148.59 | 0.5 | >1000 | >1000 | |
| 1780 | Ac- | I | $r8 | I | A | Q | A | L | R | St | I | G | D | E | F | N | $s8Y | Y | A | | | -NH$_2$ | 1199.18 | 1199.74 | >40 | 1.1 | 1.1 | 22.0 |
| 1781 | Ac- | I | W | I | A | $ | A | L | R | St | I | G | D | E | F | N | $s8Y | Y | A | | | -NH$_2$ | 1207.17 | 1207.7 | >40 | 1.6 | 1.6 | 19.2 |
| 1782 | Ac- | I | W | I | A | Q | A | L | R | $r8I | G | D | E | F | N | St | Y | Y | A | $r5A | | -NH$_2$ | 1306.72 | 1307.42 | >40 | 11.6 | 24.2 | 57.7 |

*Raji Cell Viability, 48 h, 5% serum

Example 3: Dose-Dependent Cell Killing by Peptidomimetic Macrocycles

Figure 2:
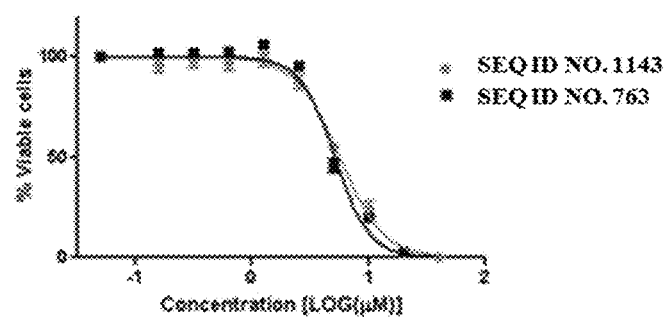
FIG. 2 illustrates cell viability over time after treatment with a peptidomimetic macrocycle.
Figure 3:
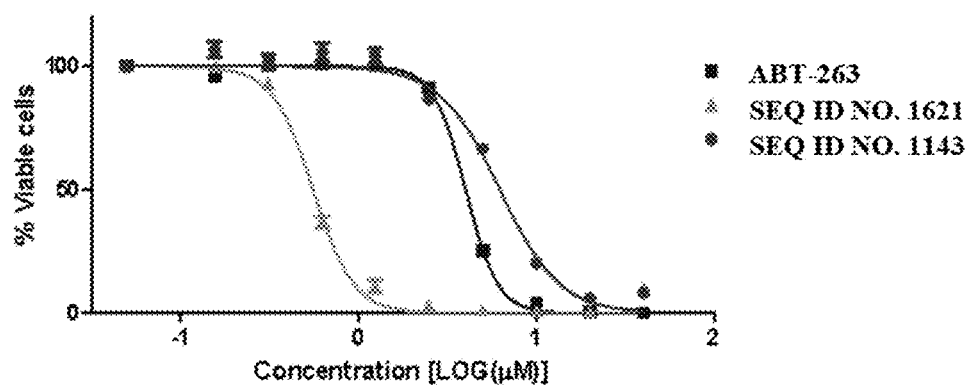
FIG. 3 illustrates cell viability over time after treatment with a peptidomimetic macrocycle.
Figure 4:
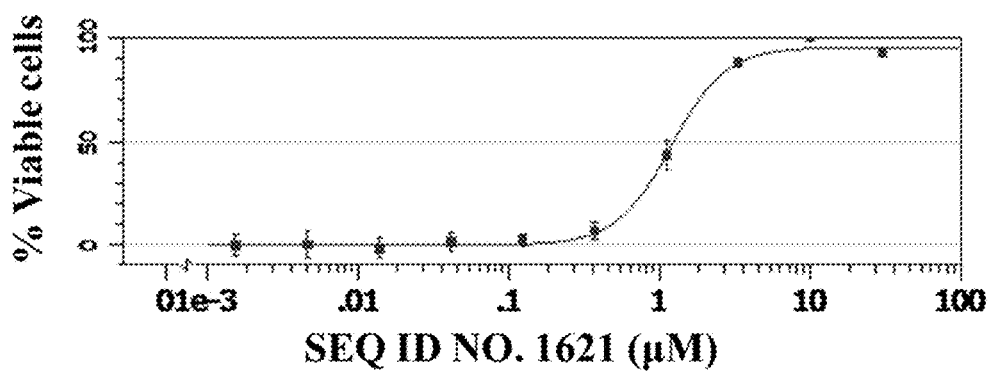
FIG. 4 illustrates cell viability over time after treatment with a peptidomimetic macrocycle.

BIM peptidomimetic macrocycles were tested for cell killing at various concentrations. Human Raji cells were treated with increasing doses of peptidomimetic macrocycles corresponding to SEQ ID NO. 763 (FIGS. 1 and 2), 1143 (FIGS. 1-3), and 1621 (FIGS. 3 and 4). An % Viable cells was calculated for each dose of the peptidomimetic macrocycle from a non-linear fit of response vs dose (GraphPad Prism). The effect of the peptidomimetic macrocycles corresponding to SEQ ID NO. 763 are presented in FIGS. 1 and 2. The effect of the peptidomimetic macrocycles corresponding to SEQ ID NO. 1143 are presented in FIGS. 1-3. The effect of the peptidomimetic macrocycles corresponding to SEQ ID NO. 1621 are presented in FIGS. 3 and 4.

Example 4: MCL-1 Displacement Study

Figure 5:
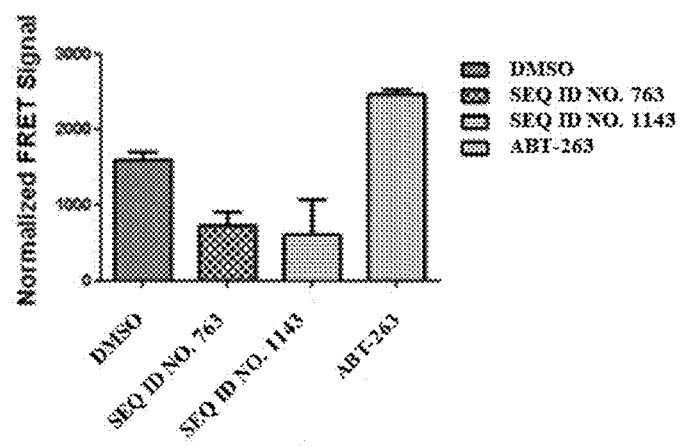
FIG. 5 illustrates normalized fluorescence resonance energy transfer (FRET) signal after treatment with vehicle, a peptidomimetic macrocycle, or a BH3 mimetic.

BIM peptidomimetic macrocycles were tested for displacement of MCL-1 from a BAK fluorescence resonance energy transfer (FRET) peptide. Human Raji cells were treated with DMSO, ABT-263, and peptidomimetic macrocycles corresponding to SEQ ID NO. 763 and 1143. FIG. 5 shows the effect of the compounds on normalized BAK peptide FRET signal.

Example 5: Pharmacokinetic (PK) and Biodistribution Study in Mice

Figure 6:
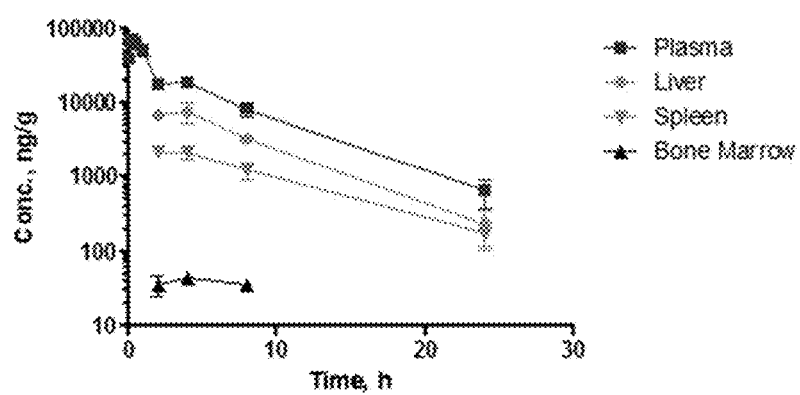
FIG. 6 illustrates concentration of a peptidomimetic macrocycle in tissue over time after treatment.

A peptidomimetic macrocycle corresponding to SEQ ID NO. 763 was administered to mice at a 5 mg/kg dose. Mice were sacrificed at specific timepoints both before and after dosing, up to 24 hours post-administration. Blood, liver, and spleen were collected from the mice at the specific time points. Plasma was prepared from the blood using K2EDTA tubes by centrifuging for 20 minutes at 4° C. at 2000 G maximum 30 minutes after collection. From each plasma sample, an aliquot was transferred to a fresh tube for PK studies. From each liver and spleen sample, tissue was homogenized and extracts were prepared for biodistribution studies. FIG. 6 shows the PK and biodistribution results for this study by concentration in nanograms of peptidomimetic macrocycle per gram mouse body weight (ng/g) over time.

Example 6: Human Plasma Stability Study

Figure 7:
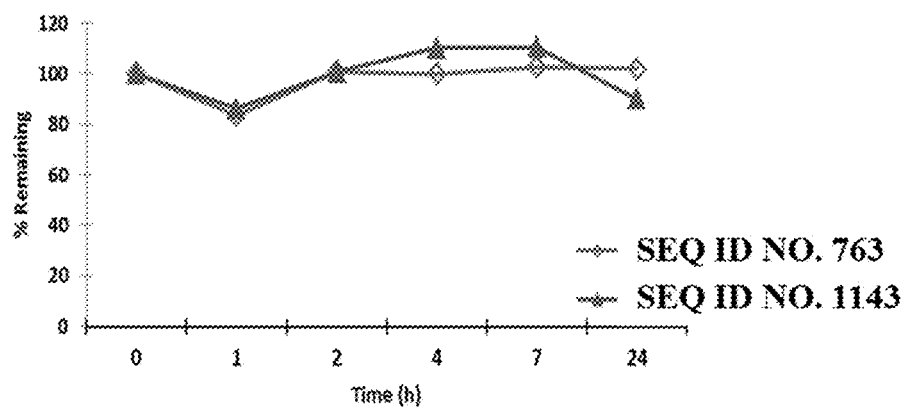
FIG. 7 illustrates percentage remaining of a peptidomimetic macrocycle in plasma over time after treatment.

Peptidomimetic macrocycles corresponding to SEQ ID NO. 763 or 1143 were administered to humans. Blood was collected at specific timepoints both before and after dosing, up to 24 hours post-administration. Plasma was prepared from the blood using K2EDTA tubes by centrifuging for 20 minutes at 4° C. at 2000 G maximum 30 minutes after collection. From each plasma sample, an aliquot was transferred to a fresh tube for plasma stability studies. FIG. 7 shows the plasma stability results for this study as a percentage of peptidomimetic macrocycle remaining in plasma over time, with the dashed line corresponding to the initial amount of peptidomimetic macrocycle dosed.

SEQUENCE LISTING (1783 sequences)

SEQ ID NO: 1 - protein, 21 aa, Artificial Sequence
  Description of Artificial Sequence: Synthetic peptide
  N-term Ac
  C-term NH2
IWIAQELRRIGDEFNAYYARR

SEQ ID NO: 2 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 3 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIEDAFNAYYARR

SEQ ID NO: 4 - protein, 21 aa, Artificial Sequence
  Description of Artificial Sequence: Synthetic peptide
  N-term FITC
  C-term NH2
IWIAQELRRIGDEFNAYYARR

SEQ ID NO: 5 - protein, 21 aa, Artificial Sequence
  Description of Artificial Sequence: Synthetic peptide
  N-term FITC
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 6 - protein, 21 aa, Artificial Sequence
  Description of Artificial Sequence: Synthetic peptide
  N-term FITC
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIEDAFNAYYARR

SEQ ID NO: 7 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQLRAIGDAFNAYYARR

SEQ ID NO: 8 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 9 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IRIAQQLRAIGDAFNAYYARR

SEQ ID NO: 10 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNAYYARR

SEQ ID NO: 11 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
EIWIAQQLRAIGDAFNAYYARR

SEQ ID NO: 12 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ERRIAQQLRAIGDAFNAYYARR

SEQ ID NO: 13 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IRIAQELRAIGDAFNAYYARR

SEQ ID NO: 14 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQELRAIGDAFNAYYARR

SEQ ID NO: 15 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQELRAIGDAFNAYYARR

SEQ ID NO: 16 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
EIWIAQELRAIGDAFNAYYARR

SEQ ID NO: 17 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ERWIAQELRAIGDAFNAYYARR

SEQ ID NO: 18 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
EIRIAQELRAIGDAFNAYYARR

SEQ ID NO: 19 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ERRIAQELRAIGDAFNAYYARR

SEQ ID NO: 20 - protein, 21 aa, Artificial Sequence
  Description of Artificial Sequence: Synthetic peptide
  N-term PEG1
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 21 - protein, 21 aa, Artificial Sequence
  Description of Artificial Sequence: Synthetic peptide
  N-term PEG5
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 22 - protein, 21 aa, Artificial Sequence
  Description of Artificial Sequence: Synthetic peptide
  N-term PEG11
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 23 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNASYARR

SEQ ID NO: 24 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQELRAIGDAFNASYARR

SEQ ID NO: 25 - protein, 22 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ERRIAQELRAIGDAFNASYARR

SEQ ID NO: 26 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQELRAIGDAFNAYYAR

SEQ ID NO: 27 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQELRAIGDAFNAYYA

SEQ ID NO: 28 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RRIAQELRAIGDAFNAYYX

SEQ ID NO: 29 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RRIAQELRAIGDAFNASYX

SEQ ID NO: 30 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
IWIAQELRAIXDAFNAYYAR

SEQ ID NO: 31 - protein, 20 aa, Artificial Sequence
  Description of Artificial Sequence: Synthetic peptide
  N-term Ac
  MOD_RES (9)..(9): Modified alanine amino acid connected by a reduced olefin crosslinker
  MISC_FEATURE (9)..(13): Crosslink between residues
  MOD_RES (11)..(11): 2-aminoisobutyric acid
  MOD_RES (13)..(13): Modified alanine amino acid connected by a reduced olefin crosslinker
  C-term NH2
IWIAQELRAIXDAFNAYYAR

SEQ ID NO: 32 - protein, 21 aa, Artificial Sequence
  Description of Artificial Sequence: Synthetic peptide
  N-term Ac
  C-term NH2
IRIAQELRRIGDEFNETYTRR

SEQ ID NO: 33 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IRIAQELRAIGDAFNETYTRR

SEQ ID NO: 34 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IRIAQELRAIEDAFNETYTRR

SEQ ID NO: 35 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQELRAIGDAFNAYYARR

SEQ ID NO: 36 - protein, 21 aa, Artificial Sequence
  Description of Artificial Sequence: Synthetic peptide
  N-term Pr
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 37 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
IWIAQELRAIXDAFNAYYARR

SEQ ID NO: 38 - protein, 21 aa, Artificial Sequence
  Description of Artificial Sequence: Synthetic peptide
  N-term Ac
  MOD_RES (9)..(9): Modified alanine amino acid connected by a reduced olefin crosslinker
  MISC_FEATURE (9)..(13): Crosslink between residues
  MOD_RES (11)..(11): 2-aminoisobutyric acid
  MOD_RES (13)..(13): Modified alanine amino acid connected by a reduced olefin crosslinker
  C-term NH2
IWIAQELRAIXDAFNAYYARR

SEQ ID NO: 39 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAANAYYARR

SEQ ID NO: 40 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFAAYYARR

SEQ ID NO: 41 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAAAAYYARR

SEQ ID NO: 42 - protein, 21 aa, Artificial Sequence
  Description of Artificial Sequence: Synthetic peptide
  N-term Ac
  MOD_RES (9)..(9): Modified alanine amino acid connected by a reduced olefin crosslinker
  MISC_FEATURE (9)..(13): Crosslink between residues
  MOD_RES (13)..(13): Modified alanine amino acid connected by a reduced olefin crosslinker
  C-term NH2
IWIAQELRAIGDAFNAYYARR

SEQ ID NO: 43 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
AWIAQELRAIGDAFNAYYARR

SEQ ID NO: 44 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWAAQELRAIGDAFNAYYARR

SEQ ID NO: 45 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
AWAAQELRAIGDAFNAYYARR

SEQ ID NO: 46 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIXQELRAIGDAFNAYYARR

SEQ ID NO: 47 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAAYARR

SEQ ID NO: 48 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYAARR

SEQ ID NO: 49 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAAAARR

SEQ ID NO: 50 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQELRAIGDAFNAYYXRR

SEQ ID NO: 51 - protein, 21 aa, Artificial Sequence
  Description of Artificial Sequence: Synthetic peptide
  N-term Ac
  MOD_RES (9)..(9): Modified alanine amino acid connected by a reduced olefin crosslinker
  MISC_FEATURE (9)..(13): Crosslink between residues
  MOD_RES (11)..(11): 2-aminoisobutyric acid
  MOD_RES (13)..(13): Modified alanine amino acid connected by a reduced olefin crosslinker
  C-term NH2
IAIAQELRAIXDAFNAYYARR

SEQ ID NO: 52 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
IAIAQELRAIXDAFNAYYARR

SEQ ID NO: 53 - protein, 21 aa, Artificial Sequence
  Description of Artificial Sequence: Synthetic peptide
  N-term Ac
  MOD_RES (7)..(7): 2-aminoisobutyric acid
  MOD_RES (12)..(12): Alpha-Me S5-pentenyl-alanine olefin amino acid connected by an all-carbon crosslinker comprising one double bond
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Norleucine
  C-term NH2
DIIRNIXRHLAAVGDALDRSI

SEQ ID NO: 54 - protein, 21 aa, Artificial Sequence
  Description of Artificial Sequence: Synthetic peptide
  N-term Ac
  MOD_RES (12)..(12): Alpha-Me S5-pentenyl-alanine olefin amino acid connected by an all-carbon crosslinker comprising one double bond
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Norleucine
  C-term NH2
DIIRNIARHLAAVGDALDKSI

SEQ ID NO: 55 - protein, 21 aa, Artificial Sequence
  Description of Artificial Sequence: Synthetic peptide
  N-term Ac
  MOD_RES (12)..(12): Alpha-Me S5-pentenyl-alanine olefin amino acid connected by an all-carbon crosslinker comprising one double bond
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Norleucine
  C-term NH2
DIIKNIARHLAAVGDALDRSI

SEQ ID NO: 56 - protein, 21 aa, Artificial Sequence
  Description of Artificial Sequence: Synthetic peptide
  N-term Ac
  MOD_RES (17)..(17): Norleucine
  C-term NH2
DIIRNIARHLACVGDCLDRSI

SEQ ID NO: 57 - protein, 21 aa, Artificial Sequence
  Description of Artificial Sequence: Synthetic peptide
  N-term Ac
  MOD_RES (14)..(14): 2-aminoisobutyric acid
  MOD_RES (17)..(17): Norleucine
  C-term NH2
DIIRNIARHLACVXDCLDRSI

SEQ ID NO: 58 - protein, 16 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNA

SEQ ID NO: 59 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNRSI

SEQ ID NO: 60 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNRSIARR

SEQ ID NO: 61 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
IWIAQELRAIGDALDRSI

SEQ ID NO: 62 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
IWIAQELRAVGDALDRSI

SEQ ID NO: 63 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQEARAIGAAFNAYYARR

SEQ ID NO: 64 - protein, 20 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQELRAIGDAFNAYYARR

SEQ ID NO: 65 - protein, 19 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQELRAIGDAFNAYYARR

SEQ ID NO: 66 - protein, 18 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
AQELRAIGDAFNAYYARR

SEQ ID NO: 67 - protein, 17 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
QELRAIGDAFNAYYARR

SEQ ID NO: 68 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  C-term NH2
ELRAIGDAFNAYYARR

SEQ ID NO: 69 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYAR

SEQ ID NO: 70 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYA

SEQ ID NO: 71 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYY

SEQ ID NO: 72 - protein, 17 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAY

SEQ ID NO: 73 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IAIAQELRAIGDAFNAYYARR

SEQ ID NO: 74 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAELRAIGDAFNAYYARR

SEQ ID NO: 75 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYYARR

SEQ ID NO: 76 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQEARAIGDAFNAYYARR

SEQ ID NO: 77 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELAAIGDAFNAYYARR

SEQ ID NO: 78 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAAGDAFNAYYARR

SEQ ID NO: 79 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIADAFNAYYARR

SEQ ID NO: 80 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGAAFNAYYARR

SEQ ID NO: 81 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYAAR

SEQ ID NO: 82 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARA

SEQ ID NO: 83 - protein, 21 aa, Artificial Sequence
  Description of Artificial Sequence: Synthetic peptide
  N-term Pr
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RNIARHLAAVGDAFNAYYARR

SEQ ID NO: 84 - protein, 21 aa, Artificial Sequence
  Description of Artificial Sequence: Synthetic peptide
  N-term Pr
  MOD_RES (8)..(8): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RNIARHLXAVGDAFNAYYARR

SEQ ID NO: 85 - protein, 21 aa, Artificial Sequence
  Description of Artificial Sequence: Synthetic peptide
  N-term Pr
  MOD_RES (4)..(4): 2-aminoisobutyric acid
  MOD_RES (8)..(8): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RNIXRHLXAVGDAFNAYYARR

SEQ ID NO: 86 - protein, 21 aa, Artificial Sequence
  Description of Artificial Sequence: Synthetic peptide
  N-term Pr
  MOD_RES (3)..(3): Cyclohexyl-Gly
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
RNGARHLAAVXDAFNAYYARR

SEQ ID NO: 87 - protein, 21 aa, Artificial Sequence
  Description of Artificial Sequence: Synthetic peptide
  N-term Pr
  MOD_RES (3)..(3): Cyclohexyl-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
RNAARHLAAVXDAFNAYYARR

SEQ ID NO: 88 - protein, 22 aa, Artificial Sequence
  Description of Artificial Sequence: Synthetic peptide
  N-term FITC
  MOD_RES (1)..(1): Beta-Ala
  C-term NH2
AIWIAQELRRIGDEFNAYYARR

SEQ ID NO: 89 - protein, 22 aa, Artificial Sequence
  Description of Artificial Sequence: Synthetic peptide
  N-term Biotin
  MOD_RES (1)..(1): 6-aminohexanoic acid
  C-term NH2
XIWIAQELRRIGDEFNAYYARR

SEQ ID NO: 90 - protein, 23 aa, Artificial Sequence
  Description of Artificial Sequence: Synthetic peptide
  N-term KLH
  MOD_RES (2)..(2): Beta-Ala
  C-term NH2
CAIWIAQELRRIGDEFNAYYARR

SEQ ID NO: 91 - protein, 23 aa, Artificial Sequence
  Description of Artificial Sequence: Synthetic peptide
  N-term OVA
  MOD_RES (2)..(2): Beta-Ala
  C-term NH2
CAIWIAQELRRIGDEFNAYYARR

SEQ ID NO: 92 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 93 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIGDAFNAYYARR

SEQ ID NO: 94 - protein, 23 aa, Artificial Sequence
  Description of Artificial Sequence: Synthetic peptide
  N-term KLH
  MOD_RES (2)..(2): Beta-Ala
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CAIWIAQELRAIGDAFNAYYARR

SEQ ID NO: 95 - protein, 23 aa, Artificial Sequence
  Description of Artificial Sequence: Synthetic peptide
  N-term OVA
  MOD_RES (2)..(2): Beta-Ala
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CAIWIAQELRAIGDAFNAYYARR

SEQ ID NO: 96 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIEDAFNAYYARR

SEQ ID NO: 97 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIEDAFNAYYARR

SEQ ID NO: 98 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
AIWIAQELRAIGDAFNAYYARR

SEQ ID NO: 99 - protein, 21 aa, Artificial Sequence
  Description of Artificial Sequence: Synthetic peptide
  N-term Ac
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYAR

SEQ ID NO: 100 - protein, 21 aa, Artificial Sequence
  Description of Artificial Sequence: Synthetic peptide
  N-term Ac
  MOD_RES (9)..(9): Modified alanine amino acid connected by a reduced olefin crosslinker
  MISC_FEATURE (9)..(13): Crosslink between residues
  MOD_RES (13)..(13): Modified alanine amino acid connected by a reduced olefin crosslinker
  C-term NH2
IWIAQELRAIGDAFNAYYARR

SEQ ID NO: 101 - protein, 23 aa, Artificial Sequence
  Description of Artificial Sequence: Synthetic peptide
  N-term H
  MOD_RES (2)..(2): Beta-Ala
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CAIWIAQELRAIGDAFNAYYARR

SEQ ID NO: 102 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFAAYYARR

SEQ ID NO: 103 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
IWIAQALRAIXDAFNAYYARR

SEQ ID NO: 104 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRRAGDEFNAYYARR

SEQ ID NO: 105 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRRAGDAFNAYYARR

SEQ ID NO: 106 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRAAGDAFNAYYARR

SEQ ID NO: 107 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  C-term NH2
IWIAQELARIGDEFNAYYARR

SEQ ID NO: 108 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  C-term NH2
IWIAQALARIGDEFNAYYARR

SEQ ID NO: 109 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  C-term NH2
IWIAQELARIGDAFNAYYARR

SEQ ID NO: 110 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  C-term NH2
IWIAQALARIGDAFNAYYARR

SEQ ID NO: 111 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAANAYYARR

SEQ ID NO: 112 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAYYARR

SEQ ID NO: 113 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RNIAQELRAIGDAFNAYYARR

SEQ ID NO: 114 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RNIAQALRAIGDAFNAYYARR

SEQ ID NO: 115 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQALRAIGDAFNAYYARR

SEQ ID NO: 116 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RNIAQALRAIGDAANAYYARR

SEQ ID NO: 117 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQALRAIGDAANAYYARR

SEQ ID NO: 118 - protein, 21 aa, Artificial Sequence
  Description of Artificial Sequence: Synthetic peptide
  N-term H
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 119 - protein, 21 aa, Artificial Sequence
  Description of Artificial Sequence: Synthetic peptide
  N-term Ac
  MOD_RES (7)..(7): Cyclohexyl-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQEARAIGDAFNAYYARR

SEQ ID NO: 120 - protein, 21 aa, Artificial Sequence
  Description of Artificial Sequence: Synthetic peptide
  N-term Ac
  MOD_RES (3)..(3): Cyclohexyl-Gly
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWGAQELRAIGDAFNAYYARR

SEQ ID NO: 121 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IRIAQALRAIGDAFNAYYARR

SEQ ID NO: 122 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQXLRAIGDAFNAYYARR

SEQ ID NO: 123 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIXQALRAIGDAFNAYYARR

SEQ ID NO: 124 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXYYARR

SEQ ID NO: 125 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQALRAIGDAFNAYYXRR

SEQ ID NO: 126 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNASIARR

SEQ ID NO: 127 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAFYARR

SEQ ID NO: 128 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAFFARR

SEQ ID NO: 129 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNARRA

SEQ ID NO: 130 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYKA

SEQ ID NO: 131 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYK

SEQ ID NO: 132 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNASKARR

SEQ ID NO: 133 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAANAYYARR

SEQ ID NO: 134 - protein, 20 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAYYARR

SEQ ID NO: 135 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAYYARR

SEQ ID NO: 136 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGNAFNAYYARR

SEQ ID NO: 137 - protein, 21 aa, Artificial Sequence
  Description of Artificial Sequence: Synthetic peptide
  N-term H
  MOD_RES (1)..(1): N-methylated arginine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 138 - protein, 21 aa, Artificial Sequence
  Description of Artificial Sequence: Synthetic peptide
  N-term Ac
  MOD_RES (1)..(1): N-methylated arginine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 139 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQHLRAIGDAFNAYYARR

SEQ ID NO: 140 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQHLRAIGDAFNAYYARR

SEQ ID NO: 141 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (10)..(10): Cyclohexyl-Gly
  MOD_RES (13)..(13): Alpha-Me S5-pentenyl-alanine olefin amino acid connected by an all-carbon crosslinker comprising one double bond
  C-term NH2
RWIAQELRAGGDAFNAYYARR

SEQ ID NO: 142 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (10)..(10): Cyclohexyl-Ala
  MOD_RES (13)..(13): Alpha-Me S5-pentenyl-alanine olefin amino acid connected by an all-carbon crosslinker comprising one double bond
  C-term NH2
RWIAQELRAAGDAFNAYYARR

SEQ ID NO: 143 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQLRAIGDAFNAFFARR

SEQ ID NO: 144 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAFYARR

SEQ ID NO: 145 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYFARR

SEQ ID NO: 146 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNATIARR

SEQ ID NO: 147 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYAR

SEQ ID NO: 148 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYA

SEQ ID NO: 149 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYY

SEQ ID NO: 150 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRRAGDQFNAYYARR

SEQ ID NO: 151 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRQAGDQFNAYYARR

SEQ ID NO: 152 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
RWIAQALRAAGDQFNAYYARR

SEQ ID NO: 153 - protein, 23 aa, Artificial Sequence
  Description of Artificial Sequence: Synthetic peptide
  N-term H
  MOD_RES (2)..(2): Beta-Ala
  C-term NH2
CAIWIAQELRRIGDEFNAYYARR

SEQ ID NO: 154 - protein, 23 aa, Artificial Sequence
  Description of Artificial Sequence: Synthetic peptide
  N-term H
  MOD_RES (2)..(2): Beta-Ala
  C-term NH2
CAIWIAQELRRIGDEFNAYYARR

SEQ ID NO: 155 - protein, 23 aa, Artificial Sequence
  Description of Artificial Sequence: Synthetic peptide
  N-term H
  MOD_RES (2)..(2): Beta-Ala
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CAIWIAQELRAIGDAFNAYYARR

SEQ ID NO: 156 - protein, 23 aa, Artificial Sequence
  Description of Artificial Sequence: Synthetic peptide
  N-term H
  MOD_RES (2)..(2): Beta-Ala
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CAIWIAQELRAIGDAFNAYYARR

SEQ ID NO: 157 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNAYYAR

SEQ ID NO: 158 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQALRAIGDAFNAYYAR

SEQ ID NO: 159 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNAYYA

SEQ ID NO: 160 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQLRAIGDAFNARRA

SEQ ID NO: 161 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNARRA

SEQ ID NO: 162 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNARRA

SEQ ID NO: 163 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNARRA

SEQ ID NO: 164 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNARYA

SEQ ID NO: 165 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYRA

SEQ ID NO: 166 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNARYA

SEQ ID NO: 167 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYRA

SEQ ID NO: 168 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNASIA

SEQ ID NO: 169 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQALRAIGDAFNASIA

SEQ ID NO: 170 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQALRAIGDAFNASI

SEQ ID NO: 171 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNARR

SEQ ID NO: 172 - protein, 17 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAR

SEQ ID NO: 173 - protein, 17 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNAR

SEQ ID NO: 174 - protein, 16 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RRIAQQLRAIGDAFNX

SEQ ID NO: 175 - protein, 16 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNA

SEQ ID NO: 176 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNARRA

SEQ ID NO: 177 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNAYYA

SEQ ID NO: 178 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RRIAQQLRAIGDAFNAYYX

SEQ ID NO: 179 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQQLRAIGDAFNXRRA

SEQ ID NO: 180 - protein, 19 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIXQQLRAIGDAFNARRA

SEQ ID NO: 181 - protein, 19 aa, Artificial Sequence
  Description of Artificial Sequence: Synthetic peptide
  N-term Ac
  MOD_RES (3)..(3): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWXAQQLRAIGDAFNARRA

SEQ ID NO: 182 - protein, 19 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RXIAQQLRAIGDAFNARRA

SEQ ID NO: 183 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RFIAQQLRAIGDAFNAYYARR

SEQ ID NO: 184 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RFIAQQLRAIGDAFNARRA

SEQ ID NO: 185 - protein, 21 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RXIAQQLRAIGDAFNAYYARR

SEQ ID NO: 186 - protein, 21 aa, Artificial Sequence
  Description of Artificial Sequence: Synthetic peptide
  N-term Ac
  MOD_RES (7)..(7): homo-Phe
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQFRAIGDAFNAYYARR

SEQ ID NO: 187 - protein, 21 aa, Artificial Sequence
  Description of Artificial Sequence: Synthetic peptide
  N-term Ac
  MOD_RES (7)..(7): 3-chloro phenylalanine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQFRAIGDAFNAYYARR

SEQ ID NO: 188 - protein, 21 aa, Artificial Sequence
  Description of Artificial Sequence: Synthetic peptide
  N-term Ac
  MOD_RES (7)..(7): 1-Naphthalanine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQARAIGDAFNAYYARR

SEQ ID NO: 189 - protein, 21 aa, Artificial Sequence
  Description of Artificial Sequence: Synthetic peptide
  N-term Ac
  MOD_RES (7)..(7): 2-Naphthalanine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQARAIGDAFNAYYARR

SEQ ID NO: 190 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQEARAIGDAANAYYARR

SEQ ID NO: 191 - protein, 19 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (13)..(13): 2-aminoisobutyric acid
  C-term NH2
RRIAQALARIGDXFNARRA

SEQ ID NO: 192 - protein, 19 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  MOD_RES (13)..(13): 2-aminoisobutyric acid
  C-term NH2
RRIAQALRRAGDXFNARRA

SEQ ID NO: 193 - protein, 21 aa, Artificial Sequence
  Description of Artificial Sequence: Synthetic peptide
  N-term iBu
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 194 - protein, 21 aa, Artificial Sequence
  Description of Artificial Sequence: Synthetic peptide
  N-term Dec
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 195 - protein, 21 aa, Artificial Sequence
  Description of Artificial Sequence: Synthetic peptide
  N-term Bz
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 196 - protein, 21 aa, Artificial Sequence
  Description of Artificial Sequence: Synthetic peptide
  N-term H
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 197 - protein, 21 aa, Artificial Sequence
  Description of Artificial Sequence: Synthetic peptide
  N-term Chx
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 198 - protein, 21 aa, Artificial Sequence
  Description of Artificial Sequence: Synthetic peptide
  N-term Vrl
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 199 - protein, 21 aa, Artificial Sequence
  Description of Artificial Sequence: Synthetic peptide
  N-term PhAc
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 200 - protein, 21 aa, Artificial Sequence
  Description of Artificial Sequence: Synthetic peptide
  N-term MeImC
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 201 - protein, 21 aa, Artificial Sequence
  Description of Artificial Sequence: Synthetic peptide
  N-term Pr
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARR

SEQ ID NO: 202 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNASIARR

SEQ ID NO: 203 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNASIARR

SEQ ID NO: 204 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 205 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQALRAIGDAFNAFYA

SEQ ID NO: 206 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RRIAQQLRAIGDAFNAFYA

SEQ ID NO: 207 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHPr
RWIAQALRAIGDAFNAYYARR

SEQ ID NO: 208 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHiBu
RWIAQALRAIGDAFNAYYARR

SEQ ID NO: 209 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHChx
RWIAQALRAIGDAFNAYYARR

SEQ ID NO: 210 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHBn
RWIAQALRAIGDAFNAYYARR

SEQ ID NO: 211 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHMeChx
RWIAQALRAIGDAFNAYYARR

SEQ ID NO: 212 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHEtPh
RWIAQALRAIGDAFNAYYARR

SEQ ID NO: 213 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHsBu
RWIAQALRAIGDAFNAYYARR

SEQ ID NO: 214 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHPr
RWIAQALRAIGDAFNARR

SEQ ID NO: 215 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHiBu
RWIAQALRAIGDAFNARR

SEQ ID NO: 216 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHChx
RWIAQALRAIGDAFNARR

SEQ ID NO: 217 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHBn
RWIAQALRAIGDAFNARR

SEQ ID NO: 218 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHMeChx
RWIAQALRAIGDAFNARR

SEQ ID NO: 219 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHEtPh
RWIAQALRAIGDAFNARR

SEQ ID NO: 220 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHsBu
RWIAQALRAIGDAFNARR

SEQ ID NO: 221 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGAAFNAYYARR

SEQ ID NO: 222 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGNAFNAYYARR

SEQ ID NO: 223 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGAAFNARRA

SEQ ID NO: 224 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAFNARRA

SEQ ID NO: 225 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAFRAIGDAFNAYYARR

SEQ ID NO: 226 - protein, 23 aa, Artificial Sequence
  Description of Artificial Sequence: Synthetic peptide
  N-term H
  MOD_RES (2)..(2): 6-aminohexanoic acid
  C-term NH2
CXIWIAQELRRIGDEFNAYYARR

SEQ ID NO: 227 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQELRAIGDAFNAYYARR

SEQ ID NO: 228 - protein, 19 aa, Artificial Sequence
  Description of Artificial Sequence: Synthetic peptide
  N-term Pr
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IPIAQALRAIGDAFNARRA

SEQ ID NO: 229 - protein, 19 aa, Artificial Sequence
  Description of Artificial Sequence: Synthetic peptide
  N-term Pr
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
PWIAQALRAIGDAFNARRA

SEQ ID NO: 230 - protein, 23 aa, Artificial Sequence
  Description of Artificial Sequence: Synthetic peptide
  N-term KLH
  MOD_RES (2)..(2): 6-aminohexanoic acid
  C-term NH2
CXIWIAQELRRIGDEFNAYYARR

SEQ ID NO: 231 - protein, 23 aa, Artificial Sequence
  Description of Artificial Sequence: Synthetic peptide
  N-term OVA
  MOD_RES (2)..(2): 6-aminohexanoic acid
  C-term NH2
CXIWIAQELRRIGDEFNAYYARR

SEQ ID NO: 232 - protein, 23 aa, Artificial Sequence
  Description of Artificial Sequence: Synthetic peptide
  N-term KLH
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQELRAIGDAFNAYYARR

SEQ ID NO: 233 - protein, 23 aa, Artificial Sequence
  Description of Artificial Sequence: Synthetic peptide
  N-term OVA
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQELRAIGDAFNAYYARR

SEQ ID NO: 234 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAEELAAIGDAFDAYYA

SEQ ID NO: 235 - protein, 20 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAEELAAIGDAFDAYYA

SEQ ID NO: 236 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAEELAAIGDAFDAYYAAA

SEQ ID NO: 237 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAEELAAIGDAFDAYYAAA

SEQ ID NO: 238 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAYKARR

SEQ ID NO: 239 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYKARR

SEQ ID NO: 240 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAYK

SEQ ID NO: 241 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFK

SEQ ID NO: 242 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): homo-Phe
  C-term NH2
RWIAQALRAIGDAFNAYYARR

SEQ ID NO: 243 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): 1-Naphthalanine
  C-term NH2
RWIAQALRAIGDAANAYYARR

SEQ ID NO: 244 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): 2-Naphthalanine
  C-term NH2
RWIAQALRAIGDAANAYYARR

SEQ ID NO: 245 - protein, 21 aa, Artificial Sequence
  Description of Artificial Sequence: Synthetic peptide
  N-term Ac
  MOD_RES (2)..(2): 2-Naphthalanine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RAIAQALRAIGDAFNAYYARR

SEQ ID NO: 246 - protein, 21 aa, Artificial Sequence
  Description of Artificial Sequence: Synthetic peptide
  N-term Ac
  MOD_RES (2)..(2): homo-Phe
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RFIAQALRAIGDAFNAYYARR

SEQ ID NO: 247 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (12)..(12): Norleucine
  MOD_RES (13)..(13): Alpha-Me S5-pentenyl-alanine olefin amino acid connected by an all-carbon crosslinker comprising one double bond
  C-term NH2
RWIAQALRAIGLAFNAYYARR

SEQ ID NO: 248 - protein, 21 aa, Artificial Sequence
  Description of Artificial Sequence: Synthetic peptide
  N-term Ac
  MOD_RES (3)..(3): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWLAQALRAIGDAFNAYYARR

SEQ ID NO: 249 - protein, 21 aa, Artificial Sequence
  Description of Artificial Sequence: Synthetic peptide
  N-term Ac
  MOD_RES (6)..(6): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQLLRAIGDAFNAYYARR

SEQ ID NO: 250 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYK

SEQ ID NO: 251 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQELRAIEDAFNAYYARR

SEQ ID NO: 252 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (18)..(18): Ornithine
  C-term NH2
IWIAQALRAIGDAFNAYXARR

SEQ ID NO: 253 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (18)..(18): Ornithine
  C-term NH2
IWIAQALRAIGDAFNAYX

SEQ ID NO: 254 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYR

SEQ ID NO: 255 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYRA

SEQ ID NO: 256 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIFDAFNARRA

SEQ ID NO: 257 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNARRA

SEQ ID NO: 258 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (10)..(10): Cyclohexyl-Gly
  MOD_RES (13)..(13): Alpha-Me S5-pentenyl-alanine olefin amino acid connected by an all-carbon crosslinker comprising one double bond
  C-term NH2
IWIAQELRAGGDAFNAYYARR

SEQ ID NO: 259 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQLRAIGDAFNAYY

SEQ ID NO: 260 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRAAGDQFNAYYARR

SEQ ID NO: 261 - protein, 18 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (15)..(15): 2-aminoisobutyric acid
  C-term NH2
IWIAQALRAIGDAFXAYK

SEQ ID NO: 262 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (15)..(15): 2-aminoisobutyric acid
  C-term NH2
IWIAQALRAIGDAFXAYYARR

SEQ ID NO: 263 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAFNAFYARR

SEQ ID NO: 264 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGNAFNAFYARR

SEQ ID NO: 265 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQXLRAIGNAFNAFYARR

SEQ ID NO: 266 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGNAFNXFYARR

SEQ ID NO: 267 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQXLRAIGNAFNXFYARR

SEQ ID NO: 268 - protein, 21 aa, Artificial Sequence
  Description of Artificial Sequence: Synthetic peptide
  N-term Pr
  MOD_RES (3)..(3): Cyclohexyl-Gly
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
RNGARHLAAVXDAFNAFYARR

SEQ ID NO: 269 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIGDAFNAYYARR

SEQ ID NO: 270 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIGDAANAYYARR

SEQ ID NO: 271 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIGAAANAYYARR

SEQ ID NO: 272 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIEAAANAYYARR

SEQ ID NO: 273 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRADIGAFNAYYARR

SEQ ID NO: 274 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARADIGAANAYYARR

SEQ ID NO: 275 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIEDAFNAYYARR

SEQ ID NO: 276 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALDAIGRAFNAYYARR

SEQ ID NO: 277 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAADAIGRAANAYYARR

SEQ ID NO: 278 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAADAIERAANAYYARR

SEQ ID NO: 279 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQXLRAIGDAFNXYYARR

SEQ ID NO: 280 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQLRAIGDAFNAYRA

SEQ ID NO: 281 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (13)..(13): 2-aminoisobutyric acid
  C-term NH2
IWIAQALARIGDXFNAYYARR

SEQ ID NO: 282 - protein, 21 aa, Artificial Sequence
  Description of Artificial Sequence: Synthetic peptide
  N-term t-Bu-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 283 - protein, 21 aa, Artificial Sequence
  Description of Artificial Sequence: Synthetic peptide
  N-term non-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 284 - protein, 21 aa, Artificial Sequence
  Description of Artificial Sequence: Synthetic peptide
  N-term Et-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 285 - protein, 21 aa, Artificial Sequence
  Description of Artificial Sequence: Synthetic peptide
  N-term Chx-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 286 - protein, 21 aa, Artificial Sequence
  Description of Artificial Sequence: Synthetic peptide
  N-term iPr-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 287 - protein, 21 aa, Artificial Sequence
  Description of Artificial Sequence: Synthetic peptide
  N-term Ph-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 288 - protein, 21 aa, Artificial Sequence
  Description of Artificial Sequence: Synthetic peptide
  N-term NH2CO
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 289 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIGRAANAYYARR

SEQ ID NO: 290 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAADAIGDAANAYYARR

SEQ ID NO: 291 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALDAIGDAFNAYYARR

SEQ ID NO: 292 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGRAFNAYYARR

SEQ ID NO: 293 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIGDAANAYYARR

SEQ ID NO: 294 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAADAIGRAANAYYARR

SEQ ID NO: 295 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALDAIGRAFNAYYARR

SEQ ID NO: 296 - protein, 21 aa, Artificial Sequence
  Description of Artificial Sequence: Synthetic peptide
  N-term Ac
  C-term NH2
IWIAQALRRIGDEFNAYYARR

SEQ ID NO: 297 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAFNAYYARR

SEQ ID NO: 298 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (12)..(12): Norleucine
  MOD_RES (13)..(13): Alpha-Me S5-pentenyl-alanine olefin amino acid connected by an all-carbon crosslinker comprising one double bond
  C-term NH2
IWIAQALRAIGLAFNAYYARR

SEQ ID NO: 299 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGAAFNAFYARR

SEQ ID NO: 300 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAFNAFYARR

SEQ ID NO: 301 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (12)..(12): Norleucine
  MOD_RES (13)..(13): Alpha-Me S5-pentenyl-alanine olefin amino acid connected by an all-carbon crosslinker comprising one double bond
  C-term NH2
IWIAQALRAIGLAFNAFYARR

SEQ ID NO: 302 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAFRAIGDAFNAFYARR

SEQ ID NO: 303 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAFRAIGDAFNAFYARR

SEQ ID NO: 304 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAFRAIGNAFNAYYARR

SEQ ID NO: 305 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAFRAIGNAFNAFYARR

SEQ ID NO: 306 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(12): Crosslink between residues
  MOD_RES (12)..(12): Alpha-Me S5-pentenyl-alanine olefin amino acid connected by an all-carbon crosslinker comprising one double bond
  C-term NH2
IWIAQALRAIGAEFNAYYARR

SEQ ID NO: 307 - protein, 21 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRRAGDAFNAYYARR

SEQ ID NO: 308 - protein, 21 aa, Artificial Sequence
  Description of Artificial Sequence: Synthetic peptide
  N-term Ac
  MOD_RES (9)..(9): 2-aminoisobutyric acid
  MOD_RES (12)..(12): Alpha-Me-Asp
  C-term NH2
IWIAQALRXIGDEFNAYYARR

SEQ ID NO: 309 - protein, 21 aa, Artificial Sequence
  Description of Artificial Sequence: Synthetic peptide
  N-term Ac
  MOD_RES (9)..(9): Alpha-H S5-pentenyl-alanine olefin amino acid connected by an all-carbon crosslinker comprising one double bond
  MISC_FEATURE (9)..(13): Crosslink between residues
  MOD_RES (13)..(13): Alpha-H S5-pentenyl-alanine olefin amino acid connected by an all-carbon crosslinker comprising one double bond
  C-term NH2
IWIAQELRAIGDAFNAYYARR

SEQ ID NO: 310 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-H S5-pentenyl-alanine olefin amino acid connected by an all-carbon crosslinker comprising one double bond
  C-term NH2
IWIAQELRAIGDAFNAYYARR

SEQ ID NO: 311 - protein, 21 aa, Artificial Sequence
  Description of Artificial Sequence: Synthetic peptide
  N-term Ac
  MOD_RES (9)..(9): Alpha-H S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 312 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHiBu
IWIAQALRAIGDAFNAYYARR

SEQ ID NO: 313 - protein, 21 aa, Artificial Sequence
  Description of Artificial Sequence: Synthetic peptide
  N-term Chx
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHiBu
IWIAQALRAIGDAFNAYYARR

SEQ ID NO: 314 - protein, 21 aa, Artificial Sequence
  Description of Artificial Sequence: Synthetic peptide
  N-term Chx-U
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NHiBu
IWIAQALRAIGDAFNAYYARR

SEQ ID NO: 315 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
XIWIAQALRAIGDAFNXYYARR

SEQ ID NO: 316 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGDAFNAFYARR

SEQ ID NO: 317 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 318 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGNAFNAYYARR

SEQ ID NO: 319 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
XRWIAQALRAIGLAFNAYYARR

SEQ ID NO: 320 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGNAFNAYYARR

SEQ ID NO: 321 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
XIWIAQALRAIGLAFNAYYARR

SEQ ID NO: 322 - protein, 21 aa, Artificial Sequence
  Description of Artificial Sequence: Synthetic peptide
  N-term Ac
  MOD_RES (9)..(9): Lys with side-chain is involved in lactam formation
  MOD_RES (13)..(13): Glu with side-chain is involved in lactam formation
  C-term NH2
IWIAQELRKIGDEFNAYYARR

SEQ ID NO: 323 - protein, 21 aa, Artificial Sequence
  Description of Artificial Sequence: Synthetic peptide
  N-term Ac
  MOD_RES (9)..(9): Glu with side-chain is involved in lactam formation
  MOD_RES (13)..(13): Lys with side-chain is involved in lactam formation
  C-term NH2
IWIAQELREIGDKFNAYYARR

SEQ ID NO: 324 - protein, 21 aa, Artificial Sequence
  Description of Artificial Sequence: Synthetic peptide
  N-term Ac
  MOD_RES (9)..(9): Lys with side-chain is involved in lactam formation
  MOD_RES (11)..(11): 2-aminoisobutyric acid
  MOD_RES (13)..(13): Glu with side-chain is involved in lactam formation
  C-term NH2
IWIAQELRKIXDEFNAYYARR

SEQ ID NO: 325 - protein, 21 aa, Artificial Sequence
  Description of Artificial Sequence: Synthetic peptide
  N-term Ac
  MOD_RES (9)..(9): Glu with side-chain is involved in lactam formation
  MOD_RES (11)..(11): 2-aminoisobutyric acid
  MOD_RES (13)..(13): Lys with side-chain is involved in lactam formation
  C-term NH2
IWIAQELREIXDKFNAYYARR

SEQ ID NO: 326 - protein, 21 aa, Artificial Sequence
  Description of Artificial Sequence: Synthetic peptide
  N-term Ac
  MOD_RES (9)..(9): O-allyl serine
  MISC_FEATURE (9)..(13): Crosslink between residues
  MOD_RES (13)..(13): O-allyl serine
  C-term NH2
IWIAQELRSIGDSFNAYYARR

SEQ ID NO: 327 - protein, 21 aa, Artificial Sequence
  Description of Artificial Sequence: Synthetic peptide
  N-term Ac
  MOD_RES (9)..(9): O-allyl serine
  MISC_FEATURE (9)..(13): Crosslink between residues
  MOD_RES (11)..(11): 2-aminoisobutyric acid
  MOD_RES (13)..(13): O-allyl serine
  C-term NH2
IWIAQELRSIXDSFNAYYARR

SEQ ID NO: 328 - protein, 21 aa, Artificial Sequence
  Description of Artificial Sequence: Synthetic peptide
  N-term Ac
  MOD_RES (9)..(9): Alpha-methylated O-allyl serine
  MISC_FEATURE (9)..(13): Crosslink between residues
  MOD_RES (13)..(13): Alpha-methylated O-allyl serine
  C-term NH2
IWIAQELRSIGDSFNAYYARR

SEQ ID NO: 329 - protein, 21 aa, Artificial Sequence
  Description of Artificial Sequence: Synthetic peptide
  N-term Ac
  MOD_RES (2)..(2): Alpha-Me-Trp
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 330 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAQELRAIGDAFNAYYARR

SEQ ID NO: 331 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Alpha-Me R5-pentenyl-alanine olefin amino acid connected by an all-carbon crosslinker comprising one double bond
  C-term NH2
IWIAAELRAIGDEFNAYYARR

SEQ ID NO: 332 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
IWIAAELRAIGDEFNAYYARR

SEQ ID NO: 333 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRRIGDAFNAYYARR

SEQ ID NO: 334 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  C-term NH2
IAIAQELRAIGDEFNAYYARR

SEQ ID NO: 335 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  C-term NH2
IAQALRRIGDEFNAYYARR

SEQ ID NO: 336 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAYYARR

SEQ ID NO: 337 - protein, 20 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  C-term NH2
WIAAELRRIGDEFNAYYARR

SEQ ID NO: 338 - protein, 20 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAAELRAIGDAFNAYYARR

SEQ ID NO: 339 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  C-term NH2
IAIAQALRRIGDEFNAYYARR

SEQ ID NO: 340 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IAIAQALRAIGDAFNAYYARR

SEQ ID NO: 341 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALEAIGDAFNAYYARR

SEQ ID NO: 342 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGRAANAYYARR

SEQ ID NO: 343 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAAEAIGRAANAYYARR

SEQ ID NO: 344 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAAEAIGEAANAYYARR

SEQ ID NO: 345 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGRAFNAFYARR

SEQ ID NO: 346 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALEAIGDAFNAFYARR

SEQ ID NO: 347 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAARAIGRAANAFYARR

SEQ ID NO: 348 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAAEAIGDAANAFYARR

SEQ ID NO: 349 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAADAIGDAANAFYARR

SEQ ID NO: 350 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAAEAIGRAANAFYARR

SEQ ID NO: 351 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAARAIGDAANAFYARR

SEQ ID NO: 352 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRADIGAFNAFYARR

SEQ ID NO: 353 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGNAANAYYARR

SEQ ID NO: 354 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAARAIGNAANAYYARR

SEQ ID NO: 355 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAAEAIGNAANAYYARR

SEQ ID NO: 356 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAAEAIGNAANAYYARR

SEQ ID NO: 357 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAAEANIGAANAYYARR

SEQ ID NO: 358 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAARANIGAANAYYARR

SEQ ID NO: 359 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAANAYYARR

SEQ ID NO: 360 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARAIGNAANAYYARR

SEQ ID NO: 361 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAAEAIGNAANAYYARR

SEQ ID NO: 362 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAAEAIGNAANAYYARR

SEQ ID NO: 363 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAAEANIGAANAYYARR

SEQ ID NO: 364 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARANIGAANAYYARR

SEQ ID NO: 365 - protein, 21 aa, Artificial Sequence
  Description of Artificial Sequence: Synthetic peptide
  N-term Ac
  C-term NH2
RWIAQALRRIGNEFNAYYARR

SEQ ID NO: 366 - protein, 21 aa, Artificial Sequence
  Description of Artificial Sequence: Synthetic peptide
  N-term Ac
  C-term NH2
IWIAQALRRIGNEFNAYYARR

SEQ ID NO: 367 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIENAFNAYYARR

SEQ ID NO: 368 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIEDAFNAFYARR

SEQ ID NO: 369 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIEDAFNAFYARR

SEQ ID NO: 370 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGRAFNAYYARR

SEQ ID NO: 371 - protein, 21 aa, Artificial Sequence
  Description of Artificial Sequence: Synthetic peptide
  N-term Ac
  MOD_RES (9)..(9): Lys with side-chain is involved in lactam formation
  MOD_RES (13)..(13): Asp with side-chain is involved in lactam formation
  C-term NH2
IWIAQELRKIGDDFNAYYARR

SEQ ID NO: 372 - protein, 21 aa, Artificial Sequence
  Description of Artificial Sequence: Synthetic peptide
  N-term Ac
  MOD_RES (9)..(9): Asp with side-chain is involved in lactam formation
  MOD_RES (13)..(13): Lys with side-chain is involved in lactam formation
  C-term NH2
IWIAQELRDIGDKFNAYYARR

SEQ ID NO: 373 - protein, 22 aa, Artificial Sequence
  Description of Artificial Sequence: Synthetic peptide
  N-term FITC
  MOD_RES (1)..(1): 6-aminohexanoic acid
  C-term NH2
XRWIAQALRRIGDEFNAFYARR

SEQ ID NO: 374 - protein, 22 aa, Artificial Sequence
  Description of Artificial Sequence: Synthetic peptide
  N-term FITC
  MOD_RES (1)..(1): 6-aminohexanoic acid
  C-term NH2
XRWIAQALRRIGNEFNAYYARR

SEQ ID NO: 375 - protein, 22 aa, Artificial Sequence
  Description of Artificial Sequence: Synthetic peptide
  N-term FITC
  MOD_RES (1)..(1): 6-aminohexanoic acid
  C-term NH2
XIWIAQALRRIGNEFNAYYARR

SEQ ID NO: 376 - protein, 22 aa, Artificial Sequence
  Description of Artificial Sequence: Synthetic peptide
  N-term FITC
  MOD_RES (1)..(1): 6-aminohexanoic acid
  C-term NH2
XIWIAQELRRIGDEFNAYYARR

SEQ ID NO: 377 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
RWIAQALRAIGNAFNAYYARR

SEQ ID NO: 378 - protein, 21 aa, Artificial Sequence
  Description of Artificial Sequence: Synthetic peptide
  N-term Ac
  MOD_RES (9)..(9): S-allyl cysteine
  MISC_FEATURE (9)..(13): Crosslink between residues
  MOD_RES (13)..(13): S-allyl cysteine
  C-term NH2
IWIAQELRCIGRCFNAYYARR

SEQ ID NO: 379 - protein, 21 aa, Artificial Sequence
  Description of Artificial Sequence: Synthetic peptide
  N-term Ac
  C-term NH2
IWIAQELRCIGRCFNAYYARR

SEQ ID NO: 380 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQAARADIGAANAYYARR

SEQ ID NO: 381 - protein, 21 aa, Artificial Sequence
  Description of Artificial Sequence: Synthetic peptide
  N-term Ac
  MOD_RES (9)..(9): Modified alanine amino acid connected by a reduced olefin crosslinker
  MISC_FEATURE (9)..(13): Crosslink between residues
  MOD_RES (13)..(13): Modified alanine amino acid connected by a reduced olefin crosslinker
  C-term NH2
IWIAQQLRAIGDAFNAYYARR

SEQ ID NO: 382 - protein, 19 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  MOD_RES (15)..(15): Norleucine
  MOD_RES (16)..(16): 2-aminoisobutyric acid
  C-term NH2
XRNIARHLAAVGDALXRSI

SEQ ID NO: 383 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGDAFNAYYARR

SEQ ID NO: 384 - protein, 21 aa, Artificial Sequence
  Description of Artificial Sequence: Synthetic peptide
  N-term Ac
  MOD_RES (9)..(9): Cysteine crosslinked with butyl linkage
  MISC_FEATURE (9)..(13): Crosslink between residues
  MOD_RES (13)..(13): Cysteine crosslinked with butyl linkage
  C-term NH2
IWIAQELRCIGDCFNAYYARR

SEQ ID NO: 385 - protein, 21 aa, Artificial Sequence
  Description of Artificial Sequence: Synthetic peptide
  N-term Ac
  MOD_RES (9)..(9): Alpha-Me cysteine crosslinked with butyl linkage
  MISC_FEATURE (9)..(13): Crosslink between residues
  MOD_RES (13)..(13): Alpha-Me cysteine crosslinked with butyl linkage
  C-term NH2
IWIAQELRCIGDCFNAYYARR

SEQ ID NO: 386 - protein, 21 aa, Artificial Sequence
  Description of Artificial Sequence: Synthetic peptide
  N-term Ac
  MOD_RES (9)..(9): S-allyl cysteine
  MISC_FEATURE (9)..(13): Crosslink between residues
  MOD_RES (13)..(13): S-allyl cysteine
  C-term NH2
IWIAQELRCIGDCFNAYYARR

SEQ ID NO: 387 - protein, 21 aa, Artificial Sequence
  Description of Artificial Sequence: Synthetic peptide
  N-term Ac
  MOD_RES (9)..(9): Alpha-methylated S-allyl cysteine
  MISC_FEATURE (9)..(13): Crosslink between residues
  MOD_RES (13)..(13): Alpha-methylated S-allyl cysteine
  C-term NH2
IWIAQELRCIGDCFNAYYARR

SEQ ID NO: 388 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-H S5-pentenyl-alanine olefin amino acid connected by an all-carbon crosslinker comprising one double bond
  MISC_FEATURE (10)..(14): Crosslink between residues
  MOD_RES (14)..(14): Alpha-H S5-pentenyl-alanine olefin amino acid connected by an all-carbon crosslinker comprising one double bond
  C-term NH2
XIWIAQELRAIGDAFNAYYARR

SEQ ID NO: 389 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Cysteine crosslinked with butyl linkage
  MISC_FEATURE (10)..(14): Crosslink between residues
  MOD_RES (14)..(14): Cysteine crosslinked with butyl linkage
  C-term NH2
XIWIAQELRCIGDCFNAYYARR

SEQ ID NO: 390 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me cysteine crosslinked with butyl linkage
  MISC_FEATURE (10)..(14): Crosslink between residues
  MOD_RES (14)..(14): Alpha-Me cysteine crosslinked with butyl linkage
  C-term NH2
XIWIAQELRCIGDCINAYYARR

SEQ ID NO: 391 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): S-allyl cysteine
  MISC_FEATURE (10)..(14): Crosslink between residues
  MOD_RES (14)..(14): S-allyl cysteine
  C-term NH2
XIWIAQELRCIGDCFNAYYARR

SEQ ID NO: 392 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): O-allyl serine
  MISC_FEATURE (10)..(14): Crosslink between residues
  MOD_RES (14)..(14): O-allyl serine
  C-term NH2
XIWIAQELRSIGDSFNAYYARR

SEQ ID NO: 393 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-methylated S-allyl cysteine
  MISC_FEATURE (10)..(14): Crosslink between residues
  MOD_RES (14)..(14): Alpha-methylated S-allyl cysteine
  C-term NH2
XIWIAQELRCIGDCFNAYYARR

SEQ ID NO: 394 - protein, 21 aa, Artificial Sequence
  Description of Artificial Sequence: Synthetic peptide
  N-term Ac
  MOD_RES (9)..(9): Alpha-Me azide 1,4 triazole (4 carbon) amino acid
  MISC_FEATURE (9)..(13): Crosslink between residues
  MOD_RES (13)..(13): Alpha-Me alkyne 1,4 triazole (5 carbon) amino acid
  C-term NH2
IWIAQELRXIGDXFNAYYARR

SEQ ID NO: 395 - protein, 21 aa, Artificial Sequence
  Description of Artificial Sequence: Synthetic peptide
  N-term Ac
  MOD_RES (9)..(9): Alpha-Me alkyne 1,4 triazole (5 carbon) amino acid
  MISC_FEATURE (9)..(13): Crosslink between residues
  MOD_RES (13)..(13): Alpha-Me azide 1,4 triazole (4 carbon) amino acid
  C-term NH2
IWIAQELRXIGDXFNAYYARR

SEQ ID NO: 396 - protein, 21 aa, Artificial Sequence
  Description of Artificial Sequence: Synthetic peptide
  N-term Ac
  MOD_RES (9)..(9): Alpha-Me azide 1,5 triazole (3 carbon) amino acid
  MISC_FEATURE (9)..(13): Crosslink between residues
  MOD_RES (13)..(13): Alpha-Me alkyne 1,5 triazole (5 carbon) amino acid
  C-term NH2
IWIAQELRXIGDXFNAYYARR

SEQ ID NO: 397 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  C-term NH2
IWIAQELRXIGDXFNAYYARR

SEQ ID NO: 398 - protein, 21 aa, Artificial Sequence
  Description of Artificial Sequence: Synthetic peptide
  N-term Ac
  MOD_RES (9)..(9): Alpha-H azide 1,5 triazole (3 carbon) amino acid
  MISC_FEATURE (9)..(13): Crosslink between residues
  MOD_RES (13)..(13): Alpha-H alkyne 1,5 triazole (5 carbon) amino acid
  C-term NH2
IWIAQELRXIGDXFNAYYARR

SEQ ID NO: 399 - protein, 21 aa, Artificial Sequence
  Description of Artificial Sequence: Synthetic peptide
  N-term Ac
  MOD_RES (9)..(9): Alpha-H alkyne 1,5 triazole (5 carbon) amino acid
  MISC_FEATURE (9)..(13): Crosslink between residues
  MOD_RES (13)..(13): Alpha-H azide 1,5 triazole (3 carbon) amino acid
  C-term NH2
IWIAQELRXIGDXFNAYYARR

SEQ ID NO: 400 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me azide 1,4 triazole (4 carbon) amino acid
  MISC_FEATURE (10)..(14): Crosslink between residues
  MOD_RES (14)..(14): Alpha-Me alkyne 1,4 triazole (5 carbon) amino acid
  C-term NH2
XIWIAQELRXIGDXFNAYYARR

SEQ ID NO: 401 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me alkyne 1,4 triazole (5 carbon) amino acid
  MISC_FEATURE (10)..(14): Crosslink between residues
  MOD_RES (14)..(14): Alpha-Me azide 1,4 triazole (4 carbon) amino acid
  C-term NH2
XIWIAQELRXIGDXFNAYYARR

SEQ ID NO: 402 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me azide 1,5 triazole (3 carbon) amino acid
  MISC_FEATURE (10)..(14): Crosslink between residues
  MOD_RES (14)..(14): Alpha-Me alkyne 1,5 triazole (5 carbon) amino acid
  C-term NH2
XIWIAQELRXIGDXFNAYYARR

SEQ ID NO: 403 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me alkyne 1,5 triazole (5 carbon) amino acid
  MISC_FEATURE (10)..(14): Crosslink between residues
  MOD_RES (14)..(14): Alpha-Me azide 1,5 triazole (3 carbon) amino acid
  C-term NH2
XIWIAQELRXIGDXFNAYYARR

SEQ ID NO: 404 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-H azide 1,5 triazole (3 carbon) amino acid
  MISC_FEATURE (10)..(14): Crosslink between residues
  MOD_RES (14)..(14): Alpha-H alkyne 1,5 triazole (5 carbon) amino acid
  C-term NH2
XIWIAQELRXIGDXFNAYYARR

SEQ ID NO: 405 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-H alkyne 1,5 triazole (5 carbon) amino acid
  MISC_FEATURE (10)..(14): Crosslink between residues
  MOD_RES (14)..(14): Alpha-H azide 1,5 triazole (3 carbon) amino acid
  C-term NH2
XIWIAQELRXIGDXFNAYYARR

SEQ ID NO: 406 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIENAFNAYYARR

SEQ ID NO: 407 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
RWIAQALRAIGDAFNAFYARR

SEQ ID NO: 408 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQALRAIGNAFNAYYARR

SEQ ID NO: 409 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQALRAIGDAFNAYYARR

SEQ ID NO: 410 - protein, 21 aa, Artificial Sequence
  Description of Artificial Sequence: Synthetic peptide
  N-term Ac
  MOD_RES (4)..(4): Cyclohexyl-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 411 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): Cyclohexyl-Ala
  MOD_RES (13)..(13): Alpha-Me S5-pentenyl-alanine olefin amino acid connected by an all-carbon crosslinker comprising one double bond
  C-term NH2
RWIAQALRAIADAFNAFYARR

SEQ ID NO: 412 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 413 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Cyclohexyl-Ala
  C-term NH2
RWIAQALRAIGDAFNAFYARR

SEQ ID NO: 414 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): Cyclohexyl-Ala
  C-term NH2
RWIAQALRAIGDAFNAFYARR

SEQ ID NO: 415 - protein, 21 aa, Artificial Sequence
  Description of Artificial Sequence: Synthetic peptide
  N-term Ac
  MOD_RES (4)..(4): Cyclohexyl-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAFNAYYARR

SEQ ID NO: 416 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): Cyclohexyl-Ala
  MOD_RES (13)..(13): Alpha-Me S5-pentenyl-alanine olefin amino acid connected by an all-carbon crosslinker comprising one double bond
  C-term NH2
IWIAQALRAIANAFNAYYARR

SEQ ID NO: 417 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGNAFNAYYARR

SEQ ID NO: 418 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Cyclohexyl-Ala
  C-term NH2
IWIAQALRAIGNAFNAYYARR

SEQ ID NO: 419 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): Cyclohexyl-Ala
  C-term NH2
IWIAQALRAIGNAFNAYYARR

SEQ ID NO: 420 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MISC_FEATURE (4)..(7): Crosslink between residues
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAFYARR

SEQ ID NO: 421 - protein, 32 aa, Artificial Sequence
  Description of Artificial Sequence: Synthetic polypeptide
  N-term Ac
  C-term NH2
YGRKKRRQRRRIWIAQELRRIGDEFNAYYARR

SEQ ID NO: 422 - protein, 33 aa, Artificial Sequence
  Description of Artificial Sequence: Synthetic polypeptide
  N-term FITC
  MOD_RES (1)..(1): 6-aminohexanoic acid
  C-term NH2
XYGRKKRRQRRRIWIAQELRRIGDEFNAYYARR

SEQ ID NO: 423 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYAHR

SEQ ID NO: 424 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARH

SEQ ID NO: 425 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQSLRAIGDAFNAFYARR

SEQ ID NO: 426 - protein, 21 aa, Artificial Sequence
  Description of Artificial Sequence: Synthetic peptide
  N-term Ac
  MOD_RES (9)..(9): Alpha-H azide 1,4 triazole (4 carbon) amino acid
  MISC_FEATURE (9)..(13): Crosslink between residues
  MOD_RES (13)..(13): Alpha-H alkyne 1,4 triazole (5 carbon) amino acid
  C-term NH2
IWIAQELRXIGDXFNAYYARR

SEQ ID NO: 427 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XRWIAQALRAIGNAFNAYYARR

SEQ ID NO: 428 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XRWIAQALRAIGDAFNAFYARR

SEQ ID NO: 429 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XIWIAQALRAIGNAFNAYYARR

SEQ ID NO: 430 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XIWIAQALRAIGDAFNAYYARR

SEQ ID NO: 431 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-methylated O-allyl serine
  MISC_FEATURE (10)..(14): Crosslink between residues
  MOD_RES (14)..(14): Alpha-methylated O-allyl serine
  C-term NH2
XIWIAQELRSIGDSFNAYYARR

SEQ ID NO: 432 - protein, 22 aa, Artificial Sequence
  Description of Artificial Sequence: Synthetic peptide
  N-term Biotin
  MOD_RES (1)..(1): 6-aminohexanoic acid
  C-term NH2
XRWIAQALRRIGDEFNAFYARR

SEQ ID NO: 433 - protein, 22 aa, Artificial Sequence
  Description of Artificial Sequence: Synthetic peptide
  N-term Biotin
  MOD_RES (1)..(1): 6-aminohexanoic acid
  C-term NH2
XRWIAQALRRIGNEFNAYYARR

SEQ ID NO: 434 - protein, 22 aa, Artificial Sequence
  Description of Artificial Sequence: Synthetic peptide
  N-term Biotin
  MOD_RES (1)..(1): 6-aminohexanoic acid
  C-term NH2
XIWIAQALRRIGNEFNAYYARR

SEQ ID NO: 435 - protein, 22 aa, Artificial Sequence
  Description of Artificial Sequence: Synthetic peptide
  N-term Biotin
  MOD_RES (1)..(1): 6-aminohexanoic acid
  C-term NH2
XIWIAQALRRIGDEFNAYYARR

SEQ ID NO: 436 - protein, 22 aa, Artificial Sequence
  Description of Artificial Sequence: Synthetic peptide
  N-term FITC
  MOD_RES (1)..(1): 6-aminohexanoic acid
  C-term NH2
XIWIAQALRRIGDEFNAYYARR

SEQ ID NO: 437 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 438 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGNAFNAYYARR

SEQ ID NO: 439 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGNAFNAYYARR

SEQ ID NO: 440 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGDAFNAYYARR

SEQ ID NO: 441 - protein, 22 aa, Artificial Sequence
  Description of Artificial Sequence: Synthetic peptide
  N-term Biotin
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGDAFNAFYARR

SEQ ID NO: 442 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIGDAFNAYYARR

SEQ ID NO: 443 - protein, 19 aa, Artificial Sequence
  Description of Artificial Sequence: Synthetic peptide
  N-term Du
  MOD_RES (4)..(4): Diaminopropionic acid
  C-term NH2
IAQXLRRIGDEFNAYYARR

SEQ ID NO: 444 - protein, 19 aa, Artificial Sequence
  Description of Artificial Sequence: Synthetic peptide
  N-term Du
  MOD_RES (4)..(4): Diaminopropionic acid
  C-term NH2
IAQXLRRIGDQFNAYYARR

SEQ ID NO: 445 - protein, 20 aa, Artificial Sequence
  Description of Artificial Sequence: Synthetic peptide
  N-term Du
  MOD_RES (4)..(4): Diaminopropionic acid
  C-term NH2
WIAXALRRIGDEFNAYYARR

SEQ ID NO: 446 - protein, 20 aa, Artificial Sequence
  Description of Artificial Sequence: Synthetic peptide
  N-term Du
  MOD_RES (4)..(4): Diaminopropionic acid
  C-term NH2
WIAXALRRIGDQFNAYYARR

SEQ ID NO: 447 - protein, 22 aa, Artificial Sequence
  Description of Artificial Sequence: Synthetic peptide
  N-term 5-FAM
  MOD_RES (1)..(1): 6-aminohexanoic acid
  C-term NH2
XIWIAQALRRIGDEFNAYYARR

SEQ ID NO: 448 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGDAFNAYYARR

SEQ ID NO: 449 - protein, 22 aa, Artificial Sequence
  Description of Artificial Sequence: Synthetic peptide
  N-term 5-FAM
  MOD_RES (1)..(1): 6-aminohexanoic acid
  C-term NH2
XIWIAQAARRDIGEANAYYARR

SEQ ID NO: 450 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 451 - protein, 22 aa, Artificial Sequence
  Description of Artificial Sequence: Synthetic peptide
  N-term 5-FAM
  MOD_RES (1)..(1): 6-aminohexanoic acid
  C-term NH2
XIWIAQALRRIGDEFNAFYARR

SEQ ID NO: 452 - protein, 21 aa, Artificial Sequence
  Description of Artificial Sequence: Synthetic peptide
  N-term Ac
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 453 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQELRAIGDAFNXYYARR

SEQ ID NO: 454 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methyl-L-Phe
  C-term NH2
IWIAQELRAIGDAFNAFYARR

SEQ ID NO: 455 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (18)..(18): Alpha-methyl-L-Phe
  C-term NH2
IWIAQELRAIGDAFNAYFARR

SEQ ID NO: 456 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methylated tyrosine O-methyl ether
  C-term NH2
IWIAQELRAIGDAFNAYYARR

SEQ ID NO: 457 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (18)..(18): Alpha-methylated tyrosine O-methyl ether
  C-term NH2
IWIAQELRAIGDAFNAYYARR

SEQ ID NO: 458 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (20)..(20): Alpha-methyl-L-Arg
  C-term NH2
IWIAQELRAIGDAFNAYYARR

SEQ ID NO: 459 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYFARR

SEQ ID NO: 460 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAFYARR

SEQ ID NO: 461 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQELRAIGDAFNAFYARR

SEQ ID NO: 462 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methyl-L-Phe
  C-term NH2
RWIAQALRAIGDAFNAFYARR

SEQ ID NO: 463 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (20)..(20): Alpha-methyl-L-Arg
  C-term NH2
RWIAQALRAIGDAFNAFYARR

SEQ ID NO: 464 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALRAIGDAFNAYYARR

SEQ ID NO: 465 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IWIAAALRAIGDEFNAYYARR

SEQ ID NO: 466 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAQALRAIGDAFNAAYARR

SEQ ID NO: 467 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Lys with side-chain is involved in lactam formation
  MOD_RES (14)..(14): Asp with side-chain is involved in lactam formation
  C-term NH2
XIWIAQELRKIGDDFNAYYARR

SEQ ID NO: 468 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Asp with side-chain is involved in lactam formation
  MOD_RES (14)..(14): Lys with side-chain is involved in lactam formation
  C-term NH2
XIWIAQELRDIGDKFNAYYARR

SEQ ID NO: 469 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-H S5-pentenyl-alanine olefin amino acid connected by an all-carbon crosslinker comprising one double bond
  MISC_FEATURE (10)..(14): Crosslink between residues
  MOD_RES (14)..(14): Alpha-H S5-pentenyl-alanine olefin amino acid connected by an all-carbon crosslinker comprising one double bond
  C-term NH2
XIWIAQELRAIGDAFNAYYARR

SEQ ID NO: 470 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Cysteine thioether ortho-xylene
  MOD_RES (14)..(14): Cysteine thioether ortho-xylene
  C-term NH2
XIWIAQELRCIGDCFNAYYARR

SEQ ID NO: 471 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYAHR

SEQ ID NO: 472 - protein, 22 aa, Artificial Sequence
  Description of Artificial Sequence: Synthetic peptide
  N-term 5-FAM
  MOD_RES (1)..(1): 6-aminohexanoic acid
  C-term NH2
XRWIAQALRRIGDEFNAFYAHR

SEQ ID NO: 473 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARH

SEQ ID NO: 474 - protein, 22 aa, Artificial Sequence
  Description of Artificial Sequence: Synthetic peptide
  N-term 5-FAM
  MOD_RES (1)..(1): 6-aminohexanoic acid
  C-term NH2
XRWIAQALRRIGDEFNAFYARH

SEQ ID NO: 475 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYAAR

SEQ ID NO: 476 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARA

SEQ ID NO: 477 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQAARADIGAANAFYARR

SEQ ID NO: 478 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARADIGAANAFYARR

SEQ ID NO: 479 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIEDAFNAYYARR

SEQ ID NO: 480 - protein, 22 aa, Artificial Sequence
  Description of Artificial Sequence: Synthetic peptide
  N-term 5-FAM
  MOD_RES (1)..(1): 6-aminohexanoic acid
  C-term NH2
XIWIAQELRRIEDEFNAYYARR

SEQ ID NO: 481 - protein, 21 aa, Artificial Sequence
  Description of Artificial Sequence: Synthetic peptide
  N-term Ac
  MOD_RES (9)..(9): Norleucine
  MOD_RES (13)..(13): Norleucine
  C-term NH2
IWIAQELRLIGDLFNAYYARR

SEQ ID NO: 482 - protein, 21 aa, Artificial Sequence
  Description of Artificial Sequence: Synthetic peptide
  N-term Ac
  MOD_RES (9)..(9): 2-aminoisobutyric acid
  MOD_RES (13)..(13): 2-aminoisobutyric acid
  C-term NH2
IWIAQELRXIGDXFNAYYARR

SEQ ID NO: 483 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 484 - protein, 22 aa, Artificial Sequence
  Description of Artificial Sequence: Synthetic peptide
  N-term 5-FAM
  MOD_RES (1)..(1): 6-aminohexanoic acid
  C-term NH2
XRWIAQALRRIGDEFNAFYARR

SEQ ID NO: 485 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQALRAIGDAFNAFYARR

SEQ ID NO: 486 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXRWIAQALRAIGDAFNAFYARR

SEQ ID NO: 487 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQALRAIGDAFNAFYARR

SEQ ID NO: 488 - protein, 23 aa, Artificial Sequence
  Description of Artificial Sequence: Synthetic peptide
  N-term OVA
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQELRAIGDAFNAYYARR

SEQ ID NO: 489 - protein, 23 aa, Artificial Sequence
  Description of Artificial Sequence: Synthetic peptide
  N-term OVA
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXRWIAQQLRAIGDAFNAYYARR

SEQ ID NO: 490 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXRWIAQAARAIGRAANAFYARR

SEQ ID NO: 491 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXRWIAQALRAIGDAFNAYYARR

SEQ ID NO: 492 - protein, 23 aa, Artificial Sequence
  Description of Artificial Sequence: Synthetic peptide
  N-term H
  MOD_RES (2)..(2): 6-aminohexanoic acid
  C-term NH2
CXIWIAQALRRIGDEFNAYYARR

SEQ ID NO: 493 - protein, 23 aa, Artificial Sequence
  Description of Artificial Sequence: Synthetic peptide
  N-term OVA
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXRWIAQAARAIGDAANAYYARR

SEQ ID NO: 494 - protein, 23 aa, Artificial Sequence
  Description of Artificial Sequence: Synthetic peptide
  N-term OVA
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXRWIAQALRAIGDAFNAYYARR

SEQ ID NO: 495 - protein, 23 aa, Artificial Sequence
  Description of Artificial Sequence: Synthetic peptide
  N-term OVA
  MOD_RES (2)..(2): 6-aminohexanoic acid
  C-term NH2
CXIWIAQALRRIGDEFNAYYARR

SEQ ID NO: 496 - protein, 28 aa, Artificial Sequence
  Description of Artificial Sequence: Synthetic peptide
  N-term Ac
  MOD_RES (7)..(7): 6-aminohexanoic acid
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
HHHHHHXIWIAQAARADIGAANAYYARR

SEQ ID NO: 497 - protein, 22 aa, Artificial Sequence
  Description of Artificial Sequence: Synthetic peptide
  N-term Ac-Flag
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQAARADIGAANAYYARR

SEQ ID NO: 498 - protein, 28 aa, Artificial Sequence
  Description of Artificial Sequence: Synthetic peptide
  N-term 5-FAM
  MOD_RES (7)..(7): 6-aminohexanoic acid
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
HHHHHHXIWIAQAARADIGAANAYYARR

SEQ ID NO: 499 - protein, 22 aa, Artificial Sequence
  Description of Artificial Sequence: Synthetic peptide
  N-term 5-FAM-Flag
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQAARADIGAANAYYARR

SEQ ID NO: 500 - protein, 28 aa, Artificial Sequence
  Description of Artificial Sequence: Synthetic peptide
  N-term Ac
  MOD_RES (7)..(7): 6-aminohexanoic acid
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
HHHHHHXRWIAQALRAIGDAFNAFYARR

SEQ ID NO: 501 - protein, 22 aa, Artificial Sequence
  Description of Artificial Sequence: Synthetic peptide
  N-term Ac-Flag
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 502 - protein, 28 aa, Artificial Sequence
  Description of Artificial Sequence: Synthetic peptide
  N-term 5-FAM
  MOD_RES (7)..(7): 6-aminohexanoic acid
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
HHHHHHXRWIAQALRAIGDAFNAFYARR

SEQ ID NO: 503 - protein, 22 aa, Artificial Sequence
  Description of Artificial Sequence: Synthetic peptide
  N-term 5-FAM-Flag
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 504 - protein, 21 aa, Artificial Sequence
  Description of Artificial Sequence: Synthetic peptide
  N-term 5-FAM
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 505 - protein, 22 aa, Artificial Sequence
  Description of Artificial Sequence: Synthetic peptide
  N-term 5-FAM
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 506 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid cyclized and then 1,3-dioxolan-2-one olefin hydroxylated
  MISC_FEATURE (9)..(13): Crosslink between residues
  MOD_RES (13)..(13): Alpha-Me S5-pentenyl-alanine olefin amino acid cyclized and then 1,3-dioxolan-2-one olefin hydroxylated
  C-term NH2
IWIAQELRAIGDAFNAYYARR

SEQ ID NO: 507 - protein, 22 aa, Artificial Sequence
  Description of Artificial Sequence: Synthetic peptide
  N-term Ac
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIGDAFNAYYARR

SEQ ID NO: 508 - protein, 22 aa, Artificial Sequence
  Description of Artificial Sequence: Synthetic peptide
  N-term Ac
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 509 - protein, 23 aa, Artificial Sequence
  Description of Artificial Sequence: Synthetic peptide
  N-term H
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQALRAIGDAFNAYYARR

SEQ ID NO: 510 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XIWIAQELRAIGDAFNAYYARR

SEQ ID NO: 511 - protein, 21 aa, Artificial Sequence
  Description of Artificial Sequence: Synthetic peptide
  N-term Ac
  C-term NH2
RWIAQALRRIGDEFNAFYAHH

SEQ ID NO: 512 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYAHH

SEQ ID NO: 513 - protein, 22 aa, Artificial Sequence
  Description of Artificial Sequence: Synthetic peptide
  N-term 5-FAM
  MOD_RES (1)..(1): 6-aminohexanoic acid
  C-term NH2
XIWIAQELRRIGDEFNAYYARR

SEQ ID NO: 514 - protein, 22 aa, Artificial Sequence
  Description of Artificial Sequence: Synthetic peptide
  N-term Ac-Tat
  MOD_RES (1)..(1): 6-aminohexanoic acid
  C-term NH2
XIWIAQELRRIGDEFNAYYARR

SEQ ID NO: 515 - protein, 22 aa, Artificial Sequence
  Description of Artificial Sequence: Synthetic peptide
  N-term 5-FAM-Tat
  MOD_RES (1)..(1): 6-aminohexanoic acid
  C-term NH2
XIWIAQELRRIGDEFNAYYARR

SEQ ID NO: 516 - protein, 22 aa, Artificial Sequence
  Description of Artificial Sequence: Synthetic peptide
  N-term Ac-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIGDAFNAYYARR

SEQ ID NO: 517 - protein, 22 aa, Artificial Sequence
  Description of Artificial Sequence: Synthetic peptide
  N-term 5-FAM-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIGDAFNAYYARR

SEQ ID NO: 518 - protein, 22 aa, Artificial Sequence
  Description of Artificial Sequence: Synthetic peptide
  N-term Ac-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 519 - protein, 22 aa, Artificial Sequence
  Description of Artificial Sequence: Synthetic peptide
  N-term 5-FAM-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRAIGDAFNAFYARR

SEQ ID NO: 520 - protein, 22 aa, Artificial Sequence
  Description of Artificial Sequence: Synthetic peptide
  N-term Ac-Tat
  MOD_RES (1)..(1): 6-aminohexanoic acid
  C-term NH2
XRWIAQALRRIGDEFNAFYARR

SEQ ID NO: 521 - protein, 22 aa, Artificial Sequence
  Description of Artificial Sequence: Synthetic peptide
  N-term 5-FAM-Tat
  MOD_RES (1)..(1): 6-aminohexanoic acid
  C-term NH2
XRWIAQALRRIGDEFNAFYARR

SEQ ID NO: 522 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XRWIAQALRAIGDAFNAFYARR

SEQ ID NO: 523 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XIWIAQALRAIGDAFNAFYARR

SEQ ID NO: 524 - protein, 22 aa, Artificial Sequence
  Description of Artificial Sequence: Synthetic peptide
  N-term Ac-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIEDAFNAYYARR

SEQ ID NO: 525 - protein, 22 aa, Artificial Sequence
  Description of Artificial Sequence: Synthetic peptide
  N-term 5-FAM-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQELRAIEDAFNAYYARR

SEQ ID NO: 526 - protein, 21 aa, Artificial Sequence
  Description of Artificial Sequence: Synthetic peptide
  N-term Ac
  C-term NH2
IWIAQELRRIEDDFNAYYARR

SEQ ID NO: 527 - protein, 22 aa, Artificial Sequence
  Description of Artificial Sequence: Synthetic peptide
  N-term Ac-Tat
  MOD_RES (1)..(1): 6-aminohexanoic acid
  C-term NH2
XIWIAQELRRIEDDFNAYYARR

SEQ ID NO: 528 - protein, 22 aa, Artificial Sequence
  Description of Artificial Sequence: Synthetic peptide
  N-term 5-FAM-Tat
  MOD_RES (1)..(1): 6-aminohexanoic acid
  C-term NH2
XIWIAQELRRIEDDFNAYYARR

SEQ ID NO: 529 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQELRAIEDAFNAYYARR

SEQ ID NO: 530 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XIWIAQELRAIEDAFNAYYARR

SEQ ID NO: 531 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQAARADIGAANAYYARR

SEQ ID NO: 532 - protein, 22 aa, Artificial Sequence
  Description of Artificial Sequence: Synthetic peptide
  N-term Ac-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQAARADIGAANAYYARR

SEQ ID NO: 533 - protein, 22 aa, Artificial Sequence
  Description of Artificial Sequence: Synthetic peptide
  N-term 5-FAM-Tat
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAQAARADIGAANAYYARR

SEQ ID NO: 534 - protein, 21 aa, Artificial Sequence
  Description of Artificial Sequence: Synthetic peptide
  N-term Ac
  C-term NH2
IWIAQAARRDIGEANAYYARR

SEQ ID NO: 535 - protein, 22 aa, Artificial Sequence
  Description of Artificial Sequence: Synthetic peptide
  N-term Ac-Tat
  MOD_RES (1)..(1): 6-aminohexanoic acid
  C-term NH2
XIWIAQAARRDIGEANAYYARR

SEQ ID NO: 536 - protein, 22 aa, Artificial Sequence
  Description of Artificial Sequence: Synthetic peptide
  N-term 5-FAM-Tat
  MOD_RES (1)..(1): 6-aminohexanoic acid
  C-term NH2
XIWIAQAARRDIGEANAYYARR

SEQ ID NO: 537 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQAARADIGAANAYYARR

SEQ ID NO: 538 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid not connected by any crosslinker
  MOD_RES (14)..(14): Alpha-Me S5-pentenyl-alanine olefin amino acid not connected by any crosslinker
  C-term NH2
XIWIAQAARADIGAANAYYARR

SEQ ID NO: 539 - protein, 21 aa, Artificial Sequence
  Description of Artificial Sequence: Synthetic peptide
  N-term Ac
  C-term NH2
IWIAQELRRIEDEFNAYYARR

SEQ ID NO: 540 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQALRAIGDAFNAFYARR

SEQ ID NO: 541 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYAHH

SEQ ID NO: 542 - protein, 22 aa, Artificial Sequence
  Description of Artificial Sequence: Synthetic peptide
  N-term Tat
  MOD_RES (1)..(1): 6-aminohexanoic acid
  C-term NH2
XIWIAQELRRIGDEFNAYYARR

SEQ ID NO: 543 - protein, 22 aa, Artificial Sequence
  Description of Artificial Sequence: Synthetic peptide
  N-term 5-FAM-Tat
  MOD_RES (1)..(1): 6-aminohexanoic acid
  C-term NH2
XIWIAQELRRIEDEFNAYYARR

SEQ ID NO: 544 - protein, 21 aa, Artificial Sequence
  Description of Artificial Sequence: Synthetic peptide
  N-term Ac
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
IWIAQALRRIADEFAAYYARR

SEQ ID NO: 545 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYARR

SEQ ID NO: 546 - protein, 21 aa, Artificial Sequence
  Description of Artificial Sequence: Synthetic peptide
  N-term Ac
  C-term NH2
IWIAQELRRIEDEFNAYYARR

SEQ ID NO: 547 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQELRAIEDAFNAYYARR

SEQ ID NO: 548 - protein, 21 aa, Artificial Sequence
  Description of Artificial Sequence: Synthetic peptide
  N-term Ac
  C-term NH2
IWIAQAARRDIGEANAYYARR

SEQ ID NO: 549 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQAARADIGAANAYYARR

SEQ ID NO: 550 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me S5-pentenyl-alanine olefin amino acid not connected by any crosslinker
  C-term NH2
IWIAQALRAIGDAFNAFYARR

SEQ ID NO: 551 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYAHH

SEQ ID NO: 552 - protein, 21 aa, Artificial Sequence
  Description of Artificial Sequence: Synthetic peptide
  N-term Ac
  C-term NH2
IWIAQALRRIGDEFNAFYARR

SEQ ID NO: 553 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
XIWIAQALRAIGDEFNAYYARR

SEQ ID NO: 554 - protein, 16 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term OH
RWIAQALRAIGDAFNA

SEQ ID NO: 555 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term OH
RWIAQALRAIGDAFNAFYA

SEQ ID NO: 556 - protein, 17 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term OH
RWIAQALRAIGDAFNAF

SEQ ID NO: 557 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (21)..(21): Alpha-methyl-L-Arg
  C-term NH2
RWIAQALRAIGDAFNAFYARR

SEQ ID NO: 558 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me R8-octenyl-alanine olefin amino acid not connected by any crosslinker
  MOD_RES (17)..(17): Alpha-Me S5-pentenyl-alanine olefin amino acid not connected by any crosslinker
  C-term NH2
XIWIAQALRAIGDEFNAYYARR

SEQ ID NO: 559 - protein, 21 aa, Artificial Sequence
  Description of Artificial Sequence: Synthetic peptide
  N-term Ac
  MOD_RES (9)..(9): Alpha-Me R8-octenyl-alanine olefin amino acid not connected by any crosslinker
  MOD_RES (16)..(16): Alpha-Me S5-pentenyl-alanine olefin amino acid not connected by any crosslinker
  C-term NH2
IWIAQALRAIGDEFNAYYARR

SEQ ID NO: 560 - protein, 23 aa, Artificial Sequence
  Description of Artificial Sequence: Synthetic peptide
  N-term OVA
  MOD_RES (2)..(2): 6-aminohexanoic acid
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
CXIWIAQALRAIGDAFNAYYARR

SEQ ID NO: 561 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
IWIAAALRAIGDEFNAYYARR

SEQ ID NO: 562 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid not connected by any crosslinker
  MOD_RES (9)..(9): Alpha-Me S5-pentenyl-alanine olefin amino acid not connected by any crosslinker
  C-term NH2
IWIAAALRAIGDEFNAYYARR

SEQ ID NO: 563 - protein, 22 aa, Artificial Sequence
  Description of Artificial Sequence: Synthetic peptide
  N-term 5-FAM
  MOD_RES (1)..(1): 6-aminohexanoic acid
  MOD_RES (6)..(6): Alpha-Me R5-pentenyl-alanine olefin amino acid not connected by any crosslinker
  MOD_RES (10)..(10): Amino acid comprising two pentenyl-alanine olefin side chains that are not crosslinked
  MOD_RES (14)..(14): Alpha-Me S5-pentenyl-alanine olefin amino acid not connected by any crosslinker
  C-term NH2
XIWIAAALRAIGDAFNAYYARR

SEQ ID NO: 564 - protein, 22 aa, Artificial Sequence
  Description of Artificial Sequence: Synthetic peptide
  N-term 5-FAM
  MOD_RES (1)..(1): 6-aminohexanoic acid
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(17): Crosslink between residues
  MOD_RES (17)..(17): Alpha-Me S8-octenyl-alanine olefin amino acid connected by an all-carbon crosslinker comprising one double bond
  C-term NH2
XIWIAAALRAIGDEFNAYYARR

SEQ ID NO: 565 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term Tag5-FAM
IAQALRAIGDAFNAYYARR

SEQ ID NO: 566 - protein, 22 aa, Artificial Sequence
  Description of Artificial Sequence: Synthetic peptide
  N-term 5-FAM
  MOD_RES (1)..(1): 6-aminohexanoic acid
  MOD_RES (6)..(6): Alpha-Me S5-pentenyl-alanine olefin amino acid not connected by any crosslinker
  MOD_RES (10)..(10): Amino acid comprising two pentenyl-alanine olefin side chains that are not crosslinked
  MOD_RES (17)..(17): Alpha-Me S8-octenyl-alanine olefin amino acid not connected by any crosslinker
  C-term NH2
XIWIAAALRAIGDEFNAYYARR

SEQ ID NO: 567 - protein, 22 aa, Artificial Sequence
  Description of Artificial Sequence: Synthetic peptide
  N-term 5-FAM
  MOD_RES (1)..(1): 6-aminohexanoic acid
  MOD_RES (6)..(6): Alpha-Me R5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIWIAAALRAIGDAFNAYYARR

SEQ ID NO: 568 - protein, 21 aa, Artificial Sequence
  Description of Artificial Sequence: Synthetic peptide
  N-term Ac
  MOD_RES (12)..(12): Alpha-Me S5-pentenyl-alanine olefin amino acid connected by an all-carbon crosslinker comprising one double bond
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  C-term NH2
AAARAAARAAAAAAAAAAAAA

SEQ ID NO: 569 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
AAAAAAARAAAAAAAAAAARA

SEQ ID NO: 570 - protein, 21 aa, Artificial Sequence
  Description of Artificial Sequence: Synthetic peptide
  N-term Ac
  C-term NH2
AAARAAARAAAKAAAEAAAAA

SEQ ID NO: 571 - protein, 21 aa, Artificial Sequence
  Description of Artificial Sequence: Synthetic peptide
  N-term Ac
  C-term NH2
AAAAAAARKAAAEAAAAAARA

SEQ ID NO: 572 - protein, 16 aa, Artificial Sequence
  Description of Artificial Sequence: Synthetic peptide
  N-term Ac
  C-term NH2
AAARAAAAAARAAAAA

SEQ ID NO: 573 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid cyclized and then olefin hydroxylated
  MISC_FEATURE (9)..(13): Crosslink between residues
  MOD_RES (13)..(13): Alpha-Me S5-pentenyl-alanine olefin amino acid cyclized and then olefin hydroxylated
  C-term NH2
IWIAQELRAIGDAFNAYYARR

SEQ ID NO: 574 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid not connected by any crosslinker
  MOD_RES (9)..(9): Amino acid comprising two pentenyl-alanine olefin side chains that are not crosslinked
  MOD_RES (13)..(13): Alpha-Me S5-pentenyl-alanine olefin amino acid not connected by any crosslinker
  C-term NH2
IWIAAALRAIGDAFNAYYARR

SEQ ID NO: 575 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid not connected by any crosslinker
  MOD_RES (9)..(9): Amino acid comprising two pentenyl-alanine olefin side chains that are not crosslinked
  MOD_RES (16)..(16): Alpha-Me S8-octenyl-alanine olefin amino acid not connected by any crosslinker
  C-term NH2
IWIAAALRAIGDEFNAYYARR

SEQ ID NO: 576 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  C-term NH2
IAIAQALRAIGDEFNAYYARR

SEQ ID NO: 577 - protein, 21 aa, Artificial Sequence
  Description of Artificial Sequence: Synthetic peptide
  N-term Ac
  MOD_RES (12)..(12): Alpha-Me R8-octenyl-alanine olefin amino acid connected by an all-carbon crosslinker comprising one double bond
  MISC_FEATURE (12)..(19): Crosslink between residues
  MOD_RES (19)..(19): Alpha-Me S5-pentenyl-alanine olefin amino acid connected by an all-carbon crosslinker comprising one double bond
  C-term NH2
IWIAQALRRIGAEFNAYYARR

SEQ ID NO: 578 - protein, 21 aa, Artificial Sequence
  Description of Artificial Sequence: Synthetic peptide
  N-term Ac
  MOD_RES (2)..(2): Alpha-Me R8-octenyl-alanine olefin amino acid not connected by any crosslinker
  MOD_RES (9)..(9): Alpha-Me S5-pentenyl-alanine olefin amino acid not connected by any crosslinker
  C-term NH2
IAIAQALRAIGDEFNAYYARR

SEQ ID NO: 579 - protein, 21 aa, Artificial Sequence
  Description of Artificial Sequence: Synthetic peptide
  N-term Ac
  MOD_RES (12)..(12): Alpha-Me R8-octenyl-alanine olefin amino acid not connected by any crosslinker
  MOD_RES (19)..(19): Alpha-Me S5-pentenyl-alanine olefin amino acid not connected by any crosslinker
  C-term NH2
IWIAQALRRIGAEFNAYYARR

SEQ ID NO: 580 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RWIAQALRAIGDAFNAFYXRR

SEQ ID NO: 581 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNASYARR

SEQ ID NO: 582 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
RWIAQALRAIGDAFNAFYARR

SEQ ID NO: 583 - protein, 21 aa, Artificial Sequence
  Description of Artificial Sequence: Synthetic peptide
  N-term Ac
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQALRRIGDEFAAYYARR

SEQ ID NO: 584 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAEALRAIGDAFNAFYARR

SEQ ID NO: 585 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAEALRAIGDAFDAFYARR

SEQ ID NO: 586 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid not connected by any crosslinker
  MOD_RES (13)..(13): Alpha-Me S5-pentenyl-alanine olefin amino acid not connected by any crosslinker
  C-term NH2
RWIAQALRAIGDAFNAFYARR

SEQ ID NO: 587 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid not connected by any crosslinker
  MOD_RES (13)..(13): Alpha-Me R5-pentenyl-alanine olefin amino acid not connected by any crosslinker
  C-term NH2
RWIAQALRAIGDAFNAFYARR

SEQ ID NO: 588 - protein, 21 aa, Artificial Sequence
  Description of Artificial Sequence: Synthetic peptide
  N-term Ac
  MOD_RES (12)..(12): Alpha-Me S5-pentenyl-alanine olefin amino acid connected by an all-carbon crosslinker comprising one double bond
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRRIGAEFNAYYARR

SEQ ID NO: 589 - protein, 21 aa, Artificial Sequence
  Description of Artificial Sequence: Synthetic peptide
  N-term Ac
  MOD_RES (13)..(13): Alpha-Me S5-pentenyl-alanine olefin amino acid connected by an all-carbon crosslinker comprising one double bond
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAQALRRIGDAFNAAYARR

SEQ ID NO: 590 - protein, 21 aa, Artificial Sequence
  Description of Artificial Sequence: Synthetic peptide
  N-term Ac
  MOD_RES (14)..(14): Alpha-Me S5-pentenyl-alanine olefin amino acid connected by an all-carbon crosslinker comprising one double bond
  MISC_FEATURE (14)..(18): Crosslink between residues
  MOD_RES (18)..(18): Alpha-Me S5-pentenyl-alanine olefin amino acid connected by an all-carbon crosslinker comprising one double bond
  C-term NH2
IWIAQALRRIGDEANAYAARR

SEQ ID NO: 591 - protein, 21 aa, Artificial Sequence
  Description of Artificial Sequence: Synthetic peptide
  N-term Ac
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAQALRRIGDAFNAYYAAR

SEQ ID NO: 592 - protein, 19 aa, Artificial Sequence
  Description of Artificial Sequence: Synthetic peptide
  N-term heptenoic acid crosslinked with position 4 via a reduced olefin crosslinker
  MOD_RES (4)..(4): Modified alanine amino acid connected by a reduced olefin crosslinker
  MOD_RES (7)..(7): Modified alanine amino acid connected by a reduced olefin crosslinker
  MISC_FEATURE (7)..(11): Crosslink between residues
  MOD_RES (11)..(11): Modified alanine amino acid connected by a reduced olefin crosslinker
  C-term NH2
IAQALRAIGDAFNAYYARR

SEQ ID NO: 593 - protein, 16 aa, Artificial Sequence
  Description of Artificial Sequence: Synthetic peptide
  N-term Ac
  C-term NH2
SYDDALLMLRSIGDSL

SEQ ID NO: 594 - protein, 16 aa, Artificial Sequence
  Description of Artificial Sequence: Synthetic peptide
  N-term Ac
  C-term NH2
TEMMLAIMLRGIGDSL

SEQ ID NO: 595 - protein, 16 aa, Artificial Sequence
  Description of Artificial Sequence: Synthetic peptide
  N-term Ac
  C-term NH2
WVSEFLAIGDYVDFHY

SEQ ID NO: 596 - protein, 16 aa, Artificial Sequence
  Description of Artificial Sequence: Synthetic peptide
  N-term Ac
  C-term NH2
DLPVFILRNIGDSLIG

SEQ ID NO: 597 - protein, 16 aa, Artificial Sequence
  Description of Artificial Sequence: Synthetic peptide
  N-term Ac
  C-term NH2
VSDFDDFLTSVLDIYL

SEQ ID NO: 598 - protein, 22 aa, Artificial Sequence
  Description of Artificial Sequence: Synthetic peptide
  N-term 5-FAM
  MOD_RES (1)..(1): 6-aminohexanoic acid
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
XIWIAAALRAIGDEFNAYYARR

SEQ ID NO: 599 - protein, 22 aa, Artificial Sequence
  Description of Artificial Sequence: Synthetic peptide
  N-term 5-FAM
  MOD_RES (1)..(1): 6-aminohexanoic acid
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
XIWIAQALRRIGDEFAAYYARR

SEQ ID NO: 600 - protein, 22 aa, Artificial Sequence
  Description of Artificial Sequence: Synthetic peptide
  N-term 5-FAM
  MOD_RES (1)..(1): 6-aminohexanoic acid
  MOD_RES (3)..(3): Alpha-Me S5-pentenyl-alanine olefin amino acid connected by an all-carbon crosslinker comprising one double bond
  MISC_FEATURE (3)..(7): Crosslink between residues
  MOD_RES (7)..(7): Alpha-Me S5-pentenyl-alanine olefin amino acid connected by an all-carbon crosslinker comprising one double bond
  C-term NH2
XIAIAQALRRIGDEFNAYYARR

SEQ ID NO: 601 - protein, 22 aa, Artificial Sequence
  Description of Artificial Sequence: Synthetic peptide
  N-term 5-FAM
  MOD_RES (1)..(1): 6-aminohexanoic acid
  MOD_RES (3)..(3): Alpha-Me S5-pentenyl-alanine olefin amino acid connected by an all-carbon crosslinker comprising one double bond
  MISC_FEATURE (3)..(7): Crosslink between residues
  MOD_RES (7)..(7): Alpha-Me S5-pentenyl-alanine olefin amino acid connected by an all-carbon crosslinker comprising one double bond
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XIAIAQALRAIGDAFNAYYARR

SEQ ID NO: 602 - protein, 22 aa, Artificial Sequence
  Description of Artificial Sequence: Synthetic peptide
  N-term 5-FAM
  MOD_RES (1)..(1): 6-aminohexanoic acid
  MOD_RES (13)..(13): Alpha-Me S5-pentenyl-alanine olefin amino acid connected by an all-carbon crosslinker comprising one double bond
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
XIWIAQALRRIGAEFNAYYARR

SEQ ID NO: 603 - protein, 22 aa, Artificial Sequence
  Description of Artificial Sequence: Synthetic peptide
  N-term 5-FAM
  MOD_RES (1)..(1): 6-aminohexanoic acid
  MOD_RES (14)..(14): Alpha-Me S5-pentenyl-alanine olefin amino acid connected by an all-carbon crosslinker comprising one double bond
  MISC_FEATURE (14)..(18): Crosslink between residues
  MOD_RES (18)..(18): Alpha-Me S5-pentenyl-alanine olefin amino acid connected by an all-carbon crosslinker comprising one double bond
  C-term NH2
XIWIAQALRRIGDAFNAAYARR

SEQ ID NO: 604 - protein, 22 aa, Artificial Sequence
  Description of Artificial Sequence: Synthetic peptide
  N-term 5-FAM
  MOD_RES (1)..(1): 6-aminohexanoic acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
XIWIAQALRRIGDEANAYAARR

SEQ ID NO: 605 - protein, 22 aa, Artificial Sequence
  Description of Artificial Sequence: Synthetic peptide
  N-term 5-FAM
  MOD_RES (1)..(1): 6-aminohexanoic acid
  MOD_RES (3)..(3): Alpha-Me R8-octenyl-alanine olefin amino acid connected by an all-carbon crosslinker comprising one double bond
  MISC_FEATURE (3)..(10): Crosslink between residues
  MOD_RES (10)..(10): Alpha-Me S5-pentenyl-alanine olefin amino acid connected by an all-carbon crosslinker comprising one double bond
  C-term NH2
XIAIAQALRAIGDEFNAYYARR

SEQ ID NO: 606 - protein, 22 aa, Artificial Sequence
  Description of Artificial Sequence: Synthetic peptide
  N-term 5-FAM
  MOD_RES (1)..(1): 6-aminohexanoic acid
  MOD_RES (14)..(14): Alpha-Me R8-octenyl-alanine olefin amino acid connected by an all-carbon crosslinker comprising one double bond
  MISC_FEATURE (14)..(21): Crosslink between residues
  MOD_RES (21)..(21): Alpha-Me S5-pentenyl-alanine olefin amino acid connected by an all-carbon crosslinker comprising one double bond
  C-term NH2
XIWIAQALRRIGDAFNAYYAAR

SEQ ID NO: 607 - protein, 22 aa, Artificial Sequence
  Description of Artificial Sequence: Synthetic peptide
  N-term 5-FAM
  MOD_RES (1)..(1): 6-aminohexanoic acid
  MOD_RES (14)..(14): Alpha-Me R8-octenyl-alanine olefin amino acid connected by an all-carbon crosslinker comprising one double bond
  MISC_FEATURE (14)..(21): Crosslink between residues
  MOD_RES (21)..(21): Alpha-Me S5-pentenyl-alanine olefin amino acid connected by an all-carbon crosslinker comprising one double bond
  C-term NH2
XIWIAQALRRIGDAFNAYYAAR

SEQ ID NO: 608 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFDAFYARR

SEQ ID NO: 609 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAAALRAIGDAFNAYYARR

SEQ ID NO: 610 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
IWIAQALRAIGDAFNAAYARR

SEQ ID NO: 611 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
RWIAAALRAIGDAFNAFYARR

SEQ ID NO: 612 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
RWIAQALRAIGDAFNAAYARR

SEQ ID NO: 613 - protein, 16 aa, Artificial Sequence
  Description of Artificial Sequence: Synthetic peptide
  N-term Ac
  MOD_RES (3)..(3): Norleucine
  MOD_RES (4)..(4): Norleucine
  MOD_RES (8)..(8): Norleucine
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
TELLLAILLRAIGDAL

SEQ ID NO: 614 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
WVSEFLAIGDAVDFHY

SEQ ID NO: 615 - protein, 16 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
DLPVFILRAIGDALIG

SEQ ID NO: 616 - protein, 16 aa, Artificial Sequence
  Description of Artificial Sequence: Synthetic peptide
  N-term Ac
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
VSDFDDFLTAVLDAYL

SEQ ID NO: 617 - protein, 21 aa, Artificial Sequence
  Description of Artificial Sequence: Synthetic peptide
  N-term Ac
  MOD_RES (9)..(9): Trans-olefin amino acid that is cyclized and then olefin hydroxylated
  MISC_FEATURE (9)..(13): Crosslink between residues
  MOD_RES (13)..(13): Trans-olefin amino acid that is cyclized and then olefin hydroxylated
  C-term NH2
RWIAQALRAIGDAFNAFYARR

SEQ ID NO: 618 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQALRAIGDAFNAAYARR

SEQ ID NO: 619 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAFNXFYARR

SEQ ID NO: 620 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
RWIAQALRAIGDAFNXFYXRR

SEQ ID NO: 621 - protein, 21 aa, Artificial Sequence
  Description of Artificial Sequence: Synthetic peptide
  N-term Ac-PEG3
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 622 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RWIAQALRAIGDAFNAFYXHH

SEQ ID NO: 623 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAFNXFYAHH

SEQ ID NO: 624 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
RWIAQALRAIGDAFNXFYXHH

SEQ ID NO: 625 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methyl-L-Phe
  C-term NH2
RWIAQALRAIGDAFNAFYAHH

SEQ ID NO: 626 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 627 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
RWIAQALRAIGDAFNAFYARR

SEQ ID NO: 628 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term PEG3-NH2
RWIAQALRAIGDAFNAFYARR

SEQ ID NO: 629 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Two pentenyl-alanine olefin side chains, each of which is crosslinked to another amino acid as indicated
  MISC_FEATURE (13)..(20): Crosslink between residues
  MOD_RES (20)..(20): Alpha-Me S8-octenyl-alanine olefin amino acid connected by an all-carbon crosslinker comprising one double bond
  C-term NH2
RWIAQALRRIGDAFNAFYAAR

SEQ ID NO: 630 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
RAIAQALRAIGDEFNAFYARR

SEQ ID NO: 631 - protein, 22 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (18)..(18): Alpha-methyl-L-Phe
  C-term NH2
RWIAQALRAIGDAFNADFYARR

SEQ ID NO: 632 - protein, 21 aa, Artificial Sequence
  Description of Artificial Sequence: Synthetic peptide
  N-term Ac
  MOD_RES (9)..(9): Asp with side-chain is involved in lactam formation
  MOD_RES (13)..(13): Lys with side-chain is involved in lactam formation
  C-term NH2
RWIAQALRDIGDKFNAFYARR

SEQ ID NO: 633 - protein, 21 aa, Artificial Sequence
  Description of Artificial Sequence: Synthetic peptide
  N-term Ac
  MOD_RES (9)..(9): Lys with side-chain is involved in lactam formation
  MOD_RES (13)..(13): Asp with side-chain is involved in lactam formation
  C-term NH2
RWIAQALRKIGDDFNAFYARR

SEQ ID NO: 634 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  C-term NH2
RWIAQALRAIXDAFNAFYARR

SEQ ID NO: 635 - protein, 14 aa, Artificial Sequence
  Description of Artificial Sequence: Synthetic peptide
  N-term Ac
  MOD_RES (2)..(2): Alpha-Me R5-pentenyl-alanine olefin amino acid connected by an all-carbon crosslinker comprising one double bond
  MISC_FEATURE (2)..(6): Crosslink between residues
  MOD_RES (6)..(6): Two pentenyl-alanine olefin side chains, each of which is crosslinked to another amino acid as indicated
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
RAIGDAFNAAYARR

SEQ ID NO: 636 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  MOD_RES (17)..(17): Alpha-methyl-L-Phe
  C-term NH2
RWIAAALRAIGDAFNAFYARR

SEQ ID NO: 637 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methyl-L-Phe
  C-term NH2
RWIAAALRAIGDAFNAFYARR

SEQ ID NO: 638 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  MOD_RES (17)..(17): Alpha-methyl-L-Phe
  C-term NH2
IWIAAALRAIGDAFNAFYARR

SEQ ID NO: 639 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methyl-L-Phe
  C-term NH2
IWIAAALRAIGDAFNAFYARR

SEQ ID NO: 640 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAFYAHH

SEQ ID NO: 641 - protein, 21 aa, Artificial Sequence
  Description of Artificial Sequence: Synthetic peptide
  N-term Ac
  MOD_RES (9)..(9): Cysteine crosslinked with butyl linkage
  MISC_FEATURE (9)..(13): Crosslink between residues
  MOD_RES (13)..(13): Cysteine crosslinked with butyl linkage
  C-term NH2
RWIAQALRCIGDCFNAFYARR

SEQ ID NO: 642 - protein, 21 aa, Artificial Sequence
  Description of Artificial Sequence: Synthetic peptide
  N-term Ac
  MOD_RES (9)..(9): Cysteine crosslinked with transbutenyl linkage
  MOD_RES (13)..(13): Cysteine crosslinked with transbutenyl linkage
  C-term NH2
RWIAQALRCIGDCFNAFYARR

SEQ ID NO: 643 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQLLRAIGDAFNAFYARR

SEQ ID NO: 644 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): homo-Phe
  C-term NH2
RWIAQALRAIGDAFNAFYARR

SEQ ID NO: 645 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): Alpha-methyl-L-Phe
  MOD_RES (20)..(20): Alpha-methyl-L-Arg
  C-term NH2
RWIAQALRAIGDAFNAFYARR

SEQ ID NO: 646 - protein, 21 aa, Artificial Sequence
  Description of Artificial Sequence: Synthetic peptide
  N-term Biotin
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELRAIGDAFNAYYARR

SEQ ID NO: 647 - protein, 22 aa, Artificial Sequence
  Description of Artificial Sequence: Synthetic peptide
  N-term 5-FAM
  MOD_RES (1)..(1): 6-aminohexanoic acid
  MOD_RES (6)..(6): Alpha-Me S5-pentenyl-alanine olefin amino acid not connected by any crosslinker
  MOD_RES (10)..(10): Alpha-Me S5-pentenyl-alanine olefin amino acid not connected by any crosslinker
  C-term NH2
XIWIAAALRAIGDEFNAYYARR

SEQ ID NO: 648 - protein, 22 aa, Artificial Sequence
  Description of Artificial Sequence: Synthetic peptide
  N-term 5-FAM
  MOD_RES (1)..(1): 6-aminohexanoic acid
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
XRWIAQALRADIGAFNAFYARR

SEQ ID NO: 649 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term OH
RWIAQALRAIGDAFNAFYARR

SEQ ID NO: 650 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  C-term NH2
IWIAQALRXIGDXFNAYYARR

SEQ ID NO: 651 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQFRAIGDAFNAYYARR

SEQ ID NO: 652 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAFYAHR

SEQ ID NO: 653 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAFYARH

SEQ ID NO: 654 - protein, 21 aa, Artificial Sequence
  Description of Artificial Sequence: Synthetic peptide
  N-term Ac
  C-term NH2
RWIAQQLRRIGDEFNAFYAHH

SEQ ID NO: 655 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAFYARR

SEQ ID NO: 656 - protein, 19 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAYYAR

SEQ ID NO: 657 - protein, 19 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAFYAR

SEQ ID NO: 658 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQELDAIGDAFNAYYARR

SEQ ID NO: 659 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALDAIGDAFNAFYARR

SEQ ID NO: 660 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQLLRAIGDAFNAFYARR

SEQ ID NO: 661 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): 1-Naphthalanine
  C-term NH2
RWIAQQLRAIGDAANAYYARR

SEQ ID NO: 662 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): 1-Naphthalanine
  C-term NH2
RWIAQLLRAIGDAANAYYARR

SEQ ID NO: 663 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): 1-Naphthalanine
  C-term NH2
RWIAQALRAIGDAANAFYARR

SEQ ID NO: 664 - protein, 21 aa, Artificial Sequence
  Description of Artificial Sequence: Synthetic peptide
  N-term Ac
  MOD_RES (9)..(9): Alpha-Me azide 1,5 triazole (3 carbon) amino acid
  MISC_FEATURE (9)..(13): Crosslink between residues
  MOD_RES (13)..(13): Alpha-Me alkyne 1,5 triazole (5 carbon) amino acid
  C-term NH2
RWIAQALRXIGDXFNAFYARR

SEQ ID NO: 665 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  C-term NH2
RWIAQALRXIGDXFNAFYARR

SEQ ID NO: 666 - protein, 21 aa, Artificial Sequence
  Description of Artificial Sequence: Synthetic peptide
  N-term Ac
  MOD_RES (9)..(9): unbridged alpha-Me azide (3 carbon) amino acid
  MOD_RES (13)..(13): unbridged alpha-ME alkyne (5 carbon) amino acid
  C-term NH2
RWIAQALRAIGDAFNAFYARR

SEQ ID NO: 667 - protein, 21 aa, Artificial Sequence
  Description of Artificial Sequence: Synthetic peptide
  N-term Ac
  MOD_RES (9)..(9): unbridged alpha-ME alkyne (5 carbon) amino acid
  MOD_RES (13)..(13): unbridged alpha-Me azide (3 carbon) amino acid
  C-term NH2
RWIAQALRAIGDAFNAFYARR

SEQ ID NO: 668 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNASYARR

SEQ ID NO: 669 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
NIAQQLRAIGDAFNASYARR

SEQ ID NO: 670 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
SIAQQLRAIGDAFNASYARR

SEQ ID NO: 671 - protein, 19 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNASYAR

SEQ ID NO: 672 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQNLRAIGDAFNAYYARR

SEQ ID NO: 673 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQRLRAIGDAFNAYYARR

SEQ ID NO: 674 - protein, 20 aa, Artificial Sequence
  Description of Artificial Sequence: Synthetic peptide
  N-term Pr
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
WIAQALRRAGDAFNASYARR

SEQ ID NO: 675 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYAHR

SEQ ID NO: 676 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYARH

SEQ ID NO: 677 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYAHH

SEQ ID NO: 678 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNASIARR

SEQ ID NO: 679 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQLRAIEDAFNAYYARR

SEQ ID NO: 680 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 681 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELDAIGDAFNAYYARR

SEQ ID NO: 682 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ARWIAQALRAIGDAFNAFYARR

SEQ ID NO: 683 - protein, 22 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ARWIAQALDAIGDAFNAFYARR

SEQ ID NO: 684 - protein, 21 aa, Artificial Sequence
  Description of Artificial Sequence: Synthetic peptide
  N-term HBS
  MOD_RES (3)..(3): N-allyl alanine after metathesis cyclization
  C-term NH2
IWAAQELRRIGDEFNAYYARR

SEQ ID NO: 685 - protein, 23 aa, Artificial Sequence
  Description of Artificial Sequence: Synthetic peptide
  N-term FITC
  MOD_RES (1)..(1): Beta-Ala
  MOD_RES (2)..(2): Beta-Ala
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
AARWIAQALRAIGDAFNAFYARR

SEQ ID NO: 686 - protein, 22 aa, Artificial Sequence
  Description of Artificial Sequence: Synthetic peptide
  N-term 5-TAMRA
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 687 - protein, 22 aa, Artificial Sequence
  Description of Artificial Sequence: Synthetic peptide
  N-term 5-TAMRA
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
ARWIAQALRAIGDAFNAFYARR

SEQ ID NO: 688 - protein, 22 aa, Artificial Sequence
  Description of Artificial Sequence: Synthetic peptide
  N-term 5-TAMRA
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIEDAFNAYYARR

SEQ ID NO: 689 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNASYARR

SEQ ID NO: 690 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQQLRAIGDAFNAAYARR

SEQ ID NO: 691 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (17)..(17): 13C labeled phenyl group of phenylalanine
  C-term NH2
RWIAQALRAIGDAFNAFYARR

SEQ ID NO: 692 - protein, 20 aa, Artificial Sequence
  Description of Artificial Sequence: Synthetic peptide
  N-term Ac
  MOD_RES (8)..(8): Alpha-Me R5-pentenyl-alanine olefin amino acid connected by an all-carbon crosslinker comprising one double bond
  MISC_FEATURE (8)..(12): Crosslink between residues
  MOD_RES (12)..(12): Two pentenyl-alanine olefin side chains, each of which is crosslinked to another amino acid as indicated
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  C-term NH2
WIAQQLRAIGDAFNAAYARR

SEQ ID NO: 693 - protein, 19 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQELRAIGDAFNAYYAR

SEQ ID NO: 694 - protein, 19 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDAFNAYYAR

SEQ ID NO: 695 - protein, 21 aa, Artificial Sequence
  Description of Artificial Sequence: Synthetic peptide
  N-term Ac
  MOD_RES (4)..(4): Universal 13C, 15N labeled alanine
  MOD_RES (7)..(7): Universal 13C, 15N labeled leucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 696 - protein, 21 aa, Artificial Sequence
  Description of Artificial Sequence: Synthetic peptide
  N-term Ac
  MOD_RES (9)..(9): S-allyl cysteine
  MISC_FEATURE (9)..(13): Crosslink between residues
  MOD_RES (13)..(13): S-allyl cysteine
  C-term NH2
IWIAQELRCIGRCFNAYYARR

SEQ ID NO: 697 - protein, 21 aa, Artificial Sequence
  Description of Artificial Sequence: Synthetic peptide
  N-term Ac
  MOD_RES (9)..(9): S-allyl cysteine
  MISC_FEATURE (9)..(13): Crosslink between residues
  MOD_RES (13)..(13): S-allyl cysteine
  C-term NH2
IWIAQELRCIGDCFNAYYARR

SEQ ID NO: 698 - protein, 21 aa, Artificial Sequence
  Description of Artificial Sequence: Synthetic peptide
  N-term Ac
  MOD_RES (9)..(9): Alpha-H azide 1,5 triazole (3 carbon) amino acid
  MISC_FEATURE (9)..(13): Crosslink between residues
  MOD_RES (13)..(13): Alpha-H alkyne 1,5 triazole (5 carbon) amino acid
  C-term NH2
IWIAQELRXIGDXFNAYYARR

SEQ ID NO: 699 - protein, 22 aa, Artificial Sequence
  Description of Artificial Sequence: Synthetic peptide
  N-term FITC
  MOD_RES (1)..(1): 6-aminohexanoic acid
  MOD_RES (10)..(10): Alpha-H azide 1,5 triazole (3 carbon) amino acid
  MISC_FEATURE (10)..(14): Crosslink between residues
  MOD_RES (14)..(14): Alpha-H alkyne 1,5 triazole (5 carbon) amino acid
  C-term NH2
XIWIAQELRXIGDXFNAYYARR

SEQ ID NO: 700 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAFYARR

SEQ ID NO: 701 - protein, 19 aa, Artificial Sequence
  Description of Artificial Sequence: Synthetic peptide
  MOD_RES (4)..(4): Diaminopropionic acid
  C-term NH2
IAQXLRRIGDEFNAYYARR

SEQ ID NO: 702 - protein, 19 aa, Artificial Sequence
  Description of Artificial Sequence: Synthetic peptide
  MOD_RES (4)..(4): Diaminopropionic acid
  C-term NH2
IAQXLRRIGDQFNAYYARR

SEQ ID NO: 703 - protein, 20 aa, Artificial Sequence
  Description of Artificial Sequence: Synthetic peptide
  MOD_RES (4)..(4): Diaminopropionic acid
  C-term NH2
WIAXALRRIGDEFNAYYARR

SEQ ID NO: 704 - protein, 20 aa, Artificial Sequence
  Description of Artificial Sequence: Synthetic peptide
  MOD_RES (4)..(4): Diaminopropionic acid
  C-term NH2
WIAXALRRIGDQFNAYYARR

SEQ ID NO: 705 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term Tag5-FAM
IAQALRAIGDAFNAYYARR

SEQ ID NO: 706 - protein, 16 aa, Artificial Sequence
  Description of Artificial Sequence: Synthetic peptide
  N-term Ac
  MOD_RES (3)..(3): Norleucine
  MOD_RES (4)..(4): Norleucine
  MOD_RES (8)..(8): Norleucine
  MOD_RES (11)..(11): Alpha-Me S5-pentenyl-alanine olefin amino acid connected by an all-carbon crosslinker comprising one double bond
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
TELLLAILLRAIGDAL

SEQ ID NO: 707 - protein, 22 aa, Artificial Sequence
  Description of Artificial Sequence: Synthetic peptide
  N-term 5-TAMRA
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 708 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 709 - protein, 21 aa, Artificial Sequence
  Description of Artificial Sequence: Synthetic peptide
  N-term Ac
  MOD_RES (9)..(9): O-allyl serine
  MISC_FEATURE (9)..(13): Crosslink between residues
  MOD_RES (13)..(13): O-allyl serine
  C-term NH2
IWIAQELRSIGDSFNAYYARR

SEQ ID NO: 710 - protein, 21 aa, Artificial Sequence
  Description of Artificial Sequence: Synthetic peptide
  N-term Ac
  MOD_RES (9)..(9): O-allyl serine
  MISC_FEATURE (9)..(13): Crosslink between residues
  MOD_RES (11)..(11): 2-aminoisobutyric acid
  MOD_RES (13)..(13): O-allyl serine
  C-term NH2
IWIAQELRSIXDSFNAYYARR

SEQ ID NO: 711 - protein, 21 aa, Artificial Sequence
  Description of Artificial Sequence: Synthetic peptide
  N-term Ac
  MOD_RES (9)..(9): Alpha-methylated O-allyl serine
  MISC_FEATURE (9)..(13): Crosslink between residues
  MOD_RES (13)..(13): Alpha-methylated O-allyl serine
  C-term NH2
IWIAQELRSIGDSFNAYYARR

SEQ ID NO: 712 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAYYARR

SEQ ID NO: 713 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAVNAFYARR

SEQ ID NO: 714 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAVNAFYARR

SEQ ID NO: 715 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAVNASYARR

SEQ ID NO: 716 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAVNAFYARR

SEQ ID NO: 717 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAVNASYARR

SEQ ID NO: 718 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDALNAFYARR

SEQ ID NO: 719 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDALNAFYARR

SEQ ID NO: 720 - protein, 20 aa, Artificial Sequence
  Description of Artificial Sequence: Synthetic peptide
  N-term Ac
  MOD_RES (14)..(14): Alpha-Me S5-pentenyl-alanine olefin amino acid connected by an all-carbon crosslinker comprising one double bond
  MISC_FEATURE (14)..(18): Crosslink between residues
  MOD_RES (18)..(18): Alpha-Me S5-pentenyl-alanine olefin amino acid connected by an all-carbon crosslinker comprising one double bond
  C-term NH2
KALETLRRVGDGVARNHATA

SEQ ID NO: 721 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAVNAFYARR

SEQ ID NO: 722 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAVNASYARR

SEQ ID NO: 723 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAVNAFYAHH

SEQ ID NO: 724 - protein, 19 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAVNAFYAR

SEQ ID NO: 725 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAFYAHH

SEQ ID NO: 726 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAFYARH

SEQ ID NO: 727 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAFYAHR

SEQ ID NO: 728 - protein, 21 aa, Artificial Sequence
  Description of Artificial Sequence: Synthetic peptide
  N-term Ac
  MOD_RES (4)..(4): Universal 13C, 15N labeled alanine
  MOD_RES (7)..(7): Universal 13C, 15N labeled leucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYARR

SEQ ID NO: 729 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDALNAYYARR

SEQ ID NO: 730 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDALNASYARR

SEQ ID NO: 731 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDALNAYYARH

SEQ ID NO: 732 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDALNAYYAHR

SEQ ID NO: 733 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDALNAYYARH

SEQ ID NO: 734 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDALNAYYAHR

SEQ ID NO: 735 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDALNAYYAHH

SEQ ID NO: 736 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
SIAQQLRAIGDALNAYYARR

SEQ ID NO: 737 - protein, 20 aa, Artificial Sequence
  Description of Artificial Sequence: Synthetic peptide
  N-term Pr
  MOD_RES (1)..(1): 2-aminoisobutyric acid
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
XIAQQLRAIGDALNAYYARR

SEQ ID NO: 738 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
YIAQQLRAIGDALNAYYARR

SEQ ID NO: 739 - protein, 19 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDALNAYYAR

SEQ ID NO: 740 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RSIAQQLRAIGDALNAYYARR

SEQ ID NO: 741 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAQELRAIGDAFNAAYARR

SEQ ID NO: 742 - protein, 20 aa, Artificial Sequence
  Description of Artificial Sequence: Synthetic peptide
  N-term Pr
  MOD_RES (8)..(8): Alpha-Me R5-pentenyl-alanine olefin amino acid connected by an all-carbon crosslinker comprising one double bond
  MISC_FEATURE (8)..(12): Crosslink between residues
  MOD_RES (12)..(12): Two pentenyl-alanine olefin side chains, each of which is crosslinked to another amino acid as indicated
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  C-term NH2
SIAQQLRAIGDAFNAAYARR

SEQ ID NO: 743 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAAALRADILAFNAFYARR

SEQ ID NO: 744 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  C-term NH2
RWIAQALRXDILXFNAFYARR

SEQ ID NO: 745 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAFNAYYAH

SEQ ID NO: 746 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAAALRAIDLAFNAFYARR

SEQ ID NO: 747 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  C-term NH2
RWIAQALRXILLXFNAFYARR

SEQ ID NO: 748 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDAFNAYYAHH

SEQ ID NO: 749 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAVNAYYAHR

SEQ ID NO: 750 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAVNAFYAHR

SEQ ID NO: 751 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDAVNAYYAHR

SEQ ID NO: 752 - protein, 21 aa, Artificial Sequence
  Description of Artificial Sequence: Synthetic peptide
  N-term Ac
  MOD_RES (9)..(9): Alpha-Me azide 1,5 triazole (3 carbon) amino acid
  MISC_FEATURE (9)..(13): Crosslink between residues
  MOD_RES (13)..(13): Alpha-Me alkyne 1,5 triazole (5 carbon) amino acid
  C-term NH2
RWIAQALRXDILXFNAFYARR

SEQ ID NO: 753 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
RAIAQALRAIGDLFNAFYARR

SEQ ID NO: 754 - protein, 19 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
RIAQQLRAIGDAFNAYYAH

SEQ ID NO: 755 - protein, 21 aa, Artificial Sequence
  Description of Artificial Sequence: Synthetic peptide
  N-term Ac
  MOD_RES (9)..(9): Alpha-Me azide 1,5 triazole (3 carbon) amino acid
  MISC_FEATURE (9)..(13): Crosslink between residues
  MOD_RES (13)..(13): Alpha-Me alkyne 1,5 triazole (5 carbon) amino acid
  C-term NH2
RWIAQALRXILLXFNAFYARR

SEQ ID NO: 756 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RAIAQQLRAIGDAFNAYYAH

SEQ ID NO: 757 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDALNAYYAHH

SEQ ID NO: 758 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
SIAQQLRAIGDALNAYYAHR

SEQ ID NO: 759 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAVNAFYAHR

SEQ ID NO: 760 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAAQLRAIGDAFNAYYARR

SEQ ID NO: 761 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
RWIAAQLRAIGDAFNAYYARR

SEQ ID NO: 762 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQQLRAIGDAFNXFYAHH

SEQ ID NO: 763 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDALNXFYAHH

SEQ ID NO: 764 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAAALRAIGDALNAYYARR

SEQ ID NO: 765 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
IWIAQALRAIGDAFNAAYAHH

SEQ ID NO: 766 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
RWIAAALRAIGDAFNAYYARR

SEQ ID NO: 767 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WIAQQLRAIGDAFNAYYAHH

SEQ ID NO: 768 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
SIAQQLRAIGDAFNAFYARR

SEQ ID NO: 769 - protein, 20 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
WIAQQLRAIGDAFNXFYAHH

SEQ ID NO: 770 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAVNXFYAHH

SEQ ID NO: 771 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQQLRAIGDAFNXFYAHH

SEQ ID NO: 772 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAVNXFYAHH

SEQ ID NO: 773 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDALNXFYAHH

SEQ ID NO: 774 - protein, 16 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  MISC_FEATURE (4)..(8): Crosslink between residues
  MOD_RES (8)..(8): Two pentenyl-alanine olefin side chains, each of which is crosslinked to another amino acid as indicated
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
ELRAIGDAFNAAYARR

SEQ ID NO: 775 - protein, 17 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
QELRAIGDAFNAAYARR

SEQ ID NO: 776 - protein, 18 aa, Artificial Sequence
  Description of Artificial Sequence: Synthetic peptide
  N-term Ac
  MOD_RES (6)..(6): Alpha-Me R5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AQELRAIGDAFNAAYARR

SEQ ID NO: 777 - protein, 19 aa, Artificial Sequence
  Description of Artificial Sequence: Synthetic peptide
  N-term Ac
  MOD_RES (7)..(7): Alpha-Me R5-pentenyl-alanine olefin amino acid connected by an all-carbon crosslinker comprising one double bond
  MISC_FEATURE (7)..(11): Crosslink between residues
  MOD_RES (11)..(11): Two pentenyl-alanine olefin side chains, each of which is crosslinked to another amino acid as indicated
  MISC_FEATURE (11)..(15): Crosslink between residues
  MOD_RES (15)..(15): Alpha-Me S5-pentenyl-alanine olefin amino acid connected by an all-carbon crosslinker comprising one double bond
  C-term NH2
IAQELRAIGDAFNAAYARR

SEQ ID NO: 778 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQALRAIGDAFNAAYAHH

SEQ ID NO: 779 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQQLRAIGDAFNAAYAHH

SEQ ID NO: 780 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
RWIAQALRAIGDAFNAAYAHH

SEQ ID NO: 781 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
RWIAQQLRAIGDAFNAAYAHH

SEQ ID NO: 782 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQQFRAIGDAFNAYYARR

SEQ ID NO: 783 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQFRAIGDAFNAFYAHH

SEQ ID NO: 784 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXFYAHH

SEQ ID NO: 785 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQQLRAIGDAFNXYYAHH

SEQ ID NO: 786 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXYYAHH

SEQ ID NO: 787 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAFNXYYAHH

SEQ ID NO: 788 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDALNXYYAHH

SEQ ID NO: 789 - protein, 20 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
RIAQQLRAIGDAFNXFYAHH

SEQ ID NO: 790 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
WIAQQLRAIGDAFNXYYAHH

SEQ ID NO: 791 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
RIAQQLRAIGDAFNXYYAHH

SEQ ID NO: 792 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
NIAQQLRAIGDAFNXFYAHH

SEQ ID NO: 793 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
SIAQQLRAIGDAFNXFYAHH

SEQ ID NO: 794 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
NIAQQLRAIGDAFNXYYARR

SEQ ID NO: 795 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
SIAQQLRAIGDAFNXYYARR

SEQ ID NO: 796 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAQLRAIGDAFNAYYARR

SEQ ID NO: 797 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAAALDAIGDAFNAYYARR

SEQ ID NO: 798 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALDAIGDAFNXFYAHH

SEQ ID NO: 799 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQQLRAIGDALNXFYAHH

SEQ ID NO: 800 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQQLRAIGDALNXFYAHH

SEQ ID NO: 801 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RAIAQQLRAIGDALNXFYAHH

SEQ ID NO: 802 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IRIAQQLRAIGDALNXFYAHH

SEQ ID NO: 803 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RAIAQQLRAIGDAFNXFYAHH

SEQ ID NO: 804 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IRIAQQLRAIGDAFNXFYAHH

SEQ ID NO: 805 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGAAFNXFYAHH

SEQ ID NO: 806 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGAAFNAFYAHH

SEQ ID NO: 807 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
RIAQQLRAIGDAFNXFYAHH

SEQ ID NO: 808 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
WIAQQLRAIGDAFNXFYAHH

SEQ ID NO: 809 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAINXFYAHH

SEQ ID NO: 810 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Cyclohexyl-Gly
  MOD_RES (16)..(16): 2-aminoisobutyric acid
  C-term NH2
RWIAQALRAIGDAGNXFYAHH

SEQ ID NO: 811 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQQLRAIGDAVNXFYAHH

SEQ ID NO: 812 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQQLRAIGDAINXFYAHH

SEQ ID NO: 813 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQQLRAIGDAVNXFYAHH

SEQ ID NO: 814 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQQLRAIGDAINXFYAHH

SEQ ID NO: 815 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
WIAQQLRAIGDAVNXFYAHH

SEQ ID NO: 816 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAFRAIGDAVNXFYAHH

SEQ ID NO: 817 - protein, 21 aa, Artificial Sequence
  Description of Artificial Sequence: Synthetic peptide
  N-term Ac
  MOD_RES (7)..(7): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAVNXFYAHH

SEQ ID NO: 818 - protein, 21 aa, Artificial Sequence
  Description of Artificial Sequence: Synthetic peptide
  N-term Ac
  MOD_RES (7)..(7): Cyclohexyl-Gly
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAGRAIGDAVNXFYAHH

SEQ ID NO: 819 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RWIAQALRAIGDALNAFYXHH

SEQ ID NO: 820 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
RWIAQALRAIGDAVNAFYXHH

SEQ ID NO: 821 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALDAIGDAFNXYYAHH

SEQ ID NO: 822 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAAALRAIGDAFNAYYARR

SEQ ID NO: 823 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALDAIGDAFNAYYARR

SEQ ID NO: 824 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
IWIAAALRAIGDAFNAYYXRR

SEQ ID NO: 825 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALRAIGDAVNAYYARR

SEQ ID NO: 826 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IRIAQALRAIGDAFNXFYAHH

SEQ ID NO: 827 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
INIAQALRAIGDAFNXFYAHH

SEQ ID NO: 828 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IFIAQALRAIGDAFNXFYAHH

SEQ ID NO: 829 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
ISIAQALRAIGDAFNXFYAHH

SEQ ID NO: 830 - protein, 21 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 831 - protein, 21 aa, Artificial Sequence
  Description of Artificial Sequence: Synthetic peptide
  N-term Ac
  MOD_RES (3)..(3): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWLAQALRAIGDAFNXFYAHH

SEQ ID NO: 832 - protein, 21 aa, Artificial Sequence
  Description of Artificial Sequence: Synthetic peptide
  N-term Ac
  MOD_RES (7)..(7): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXFYAHH

SEQ ID NO: 833 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIXQALRAIGDAFNXFYAHH

SEQ ID NO: 834 - protein, 19 aa, Artificial Sequence
  Description of Artificial Sequence: Synthetic peptide
  N-term Pr
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
IAQALRAIGDAFNXFYAHH

SEQ ID NO: 835 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQXLRAIGDAFNXFYAHH

SEQ ID NO: 836 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAFNXFYAHH

SEQ ID NO: 837 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQFLRAIGDAFNXFYAHH

SEQ ID NO: 838 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IAIAAFLRAIGDAFNXFYA

SEQ ID NO: 839 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
IWIAQALRAIGDAFNXYYXHH

SEQ ID NO: 840 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFAXFYAHH

SEQ ID NO: 841 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
RWIAQALRAIGDXFNAFYAHH

SEQ ID NO: 842 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
RWIAQALRAIGDAFNAFYAHH

SEQ ID NO: 843 - protein, 21 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  MISC_FEATURE (5)..(12): Crosslink between residues
  MOD_RES (9)..(9): 2-aminoisobutyric acid
  MOD_RES (12)..(12): Alpha-Me S5-pentenyl-alanine olefin amino acid connected by an all-carbon crosslinker comprising one double bond
  MOD_RES (16)..(16): 2-aminoisobutyric acid
  C-term NH2
RWIAAALRXIGAAFNXYYAHH

SEQ ID NO: 844 - protein, 21 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  MISC_FEATURE (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): 2-aminoisobutyric acid
  C-term NH2
RWIAAALRAIGAAFNXYYAHH

SEQ ID NO: 845 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Cyclohexyl-Ala
  MOD_RES (16)..(16): 2-aminoisobutyric acid
  C-term NH2
IWIAQALRAIGDAANXFYAHH

SEQ ID NO: 846 - protein, 22 aa, Artificial Sequence
  Description of Artificial Sequence: Synthetic peptide
  N-term 5-FAM
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
AIWIAQALRAIGDAFNXFYAHH

SEQ ID NO: 847 - protein, 22 aa, Artificial Sequence
  Description of Artificial Sequence: Synthetic peptide
  N-term 5-FAM
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
ARWIAQALRAIGDALNXFYAHH

SEQ ID NO: 848 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWILQALRAIXDAFNXFYAHH

SEQ ID NO: 849 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IAIAQFLRAIGDAFNXFYAHH

SEQ ID NO: 850 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAFYAHH

SEQ ID NO: 851 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IWIAQALRAIGDXFNAFYAHH

SEQ ID NO: 852 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQNLRAIGDAFNXFYAHH

SEQ ID NO: 853 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQHLRAIGDAFNXFYAHH

SEQ ID NO: 854 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAAQLRAIGDAFNXFYA

SEQ ID NO: 855 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RNIAQALRAIGDAFNXFYAHH

SEQ ID NO: 856 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RFIAQALRAIGDAFNXFYAHH

SEQ ID NO: 857 - protein, 21 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDAFNXFYAHH

SEQ ID NO: 858 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RAIAQFLRAIGDAFNXFYAHH

SEQ ID NO: 859 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQLLRAIGDAFNXFYAHH

SEQ ID NO: 860 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQFLRAIGDAFNXFYAHH

SEQ ID NO: 861 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQXLRAIGDAFNXFYAHH

SEQ ID NO: 862 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAFNXFYQHH

SEQ ID NO: 863 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQHLRAIGDAFNXFYAHH

SEQ ID NO: 864 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (10)..(10): Norleucine
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRALGDAFNXFYAHH

SEQ ID NO: 865 - protein, 19 aa, Artificial Sequence
  Description of Artificial Sequence: Synthetic peptide
  N-term Pr
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
IAQLLRAIGDAFNXFYAHH

SEQ ID NO: 866 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIALALRAIGDAFNXFYAHH

SEQ ID NO: 867 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
WIALALRAIGDAFNXFYAHH

SEQ ID NO: 868 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RAIAFALRAIGDAFNXFYAHH

SEQ ID NO: 869 - protein, 20 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
WIAQALRAIGDAFNXFYQHH

SEQ ID NO: 870 - protein, 28 aa, Artificial Sequence
  Description of Artificial Sequence: Synthetic peptide
  N-term Ac
  MOD_RES (7)..(7): Beta-Ala
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  MOD_RES (23)..(23): 2-aminoisobutyric acid
  C-term NH2
CCPGCCAIWIAQALRAIGDAFNXFYAHH

SEQ ID NO: 871 - protein, 28 aa, Artificial Sequence
  Description of Artificial Sequence: Synthetic peptide
  N-term Ac
  MOD_RES (7)..(7): Beta-Ala
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  MOD_RES (23)..(23): 2-aminoisobutyric acid
  C-term NH2
CCPGCCARWIAQALRAIGDAVNXFYAHH

SEQ ID NO: 872 - protein, 28 aa, Artificial Sequence
  Description of Artificial Sequence: Synthetic peptide
  N-term Ac
  MOD_RES (7)..(7): Beta-Ala
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  MOD_RES (23)..(23): 2-aminoisobutyric acid
  C-term NH2
CCPGCCARWIAQALRAIGDALNXFYAHH

SEQ ID NO: 873 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXFYQHH

SEQ ID NO: 874 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQXLRAIGDAFNAAYAHH

SEQ ID NO: 875 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAFNXFYQHH

SEQ ID NO: 876 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNRFYAHH

SEQ ID NO: 877 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYRHH

SEQ ID NO: 878 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQRLRAIGDAFNAFYAHH

SEQ ID NO: 879 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNARYAHH

SEQ ID NO: 880 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAERLRAIGDAFNAFYAHH

SEQ ID NO: 881 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNQFYAHH

SEQ ID NO: 882 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAFYQHH

SEQ ID NO: 883 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQELRAIGDAFNARYAHH

SEQ ID NO: 884 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDAFNAQYAHH

SEQ ID NO: 885 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQQLRAIGDAQNQQYQHH

SEQ ID NO: 886 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAAFLRAIGDAFNXFYAHH

SEQ ID NO: 887 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (15)..(15): Norleucine
  MOD_RES (16)..(16): 2-aminoisobutyric acid
  C-term NH2
IWIAQALRAIGDAFLXFYAHH

SEQ ID NO: 888 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (15)..(15): Norleucine
  MOD_RES (16)..(16): 2-aminoisobutyric acid
  C-term NH2
IWIAQALRAIGDAFLXFYQHH

SEQ ID NO: 889 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQXLRAIGDAVNXFYAHH

SEQ ID NO: 890 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAVNXFYAHH

SEQ ID NO: 891 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQAARAIGDAVNXFYAHH

SEQ ID NO: 892 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IAIAFALRAIGDAVNXFYAHH

SEQ ID NO: 893 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAVNXFYAHH

SEQ ID NO: 894 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAVNXFYQHH

SEQ ID NO: 895 - protein, 21 aa, Artificial Sequence
  Description of Artificial Sequence: Synthetic peptide
  N-term Ac
  MOD_RES (9)..(9): Alpha-Me azide 1,4 triazole (4 carbon) amino acid
  MISC_FEATURE (9)..(13): Crosslink between residues
  MOD_RES (13)..(13): Alpha-Me alkyne 1,4 triazole (3 carbon) amino acid
  C-term NH2
IWIAQELRXIGDXFNAYYARR

SEQ ID NO: 896 - protein, 21 aa, Artificial Sequence
  Description of Artificial Sequence: Synthetic peptide
  N-term Ac
  MOD_RES (9)..(9): Alpha-Me alkyne 1,4 triazole (3 carbon) amino acid
  MISC_FEATURE (9)..(13): Crosslink between residues
  MOD_RES (13)..(13): Alpha-Me azide 1,4 triazole (4 carbon) amino acid
  C-term NH2
IWIAQELRXIGDXFNAYYARR

SEQ ID NO: 897 - protein, 21 aa, Artificial Sequence
  Description of Artificial Sequence: Synthetic peptide
  N-term Ac
  MOD_RES (9)..(9): Alpha-Me azide 1,5 triazole (3 carbon) amino acid
  MISC_FEATURE (9)..(13): Crosslink between residues
  MOD_RES (13)..(13): Alpha-Me alkyne 1,4 triazole (5 carbon) amino acid
  C-term NH2
IWIAQELRXIGDXFNAYYARR

SEQ ID NO: 898 - protein, 21 aa, Artificial Sequence
  Description of Artificial Sequence: Synthetic peptide
  N-term Ac
  MOD_RES (9)..(9): Alpha-Me alkyne 1,4 triazole (5 carbon) amino acid
  MISC_FEATURE (9)..(13): Crosslink between residues
  MOD_RES (13)..(13): Alpha-Me azide 1,5 triazole (3 carbon) amino acid
  C-term NH2
IWIAQELRXIGDXFNAYYARR

SEQ ID NO: 899 - protein, 21 aa, Artificial Sequence
  Description of Artificial Sequence: Synthetic peptide
  N-term Ac
  MOD_RES (9)..(9): Alpha-Me azide 1,4 triazole (5 carbon) amino acid
  MISC_FEATURE (9)..(13): Crosslink between residues
  MOD_RES (13)..(13): Alpha-Me alkyne 1,4 triazole (5 carbon) amino acid
  C-term NH2
IWIAQELRXIGDXFNAYYARR

SEQ ID NO: 900 - protein, 21 aa, Artificial Sequence
  Description of Artificial Sequence: Synthetic peptide
  N-term Ac
  MOD_RES (9)..(9): Alpha-Me alkyne 1,4 triazole (5 carbon) amino acid
  MISC_FEATURE (9)..(13): Crosslink between residues
  MOD_RES (13)..(13): Alpha-Me azide 1,4 triazole (5 carbon) amino acid
  C-term NH2
IWIAQELRXIGDXFNAYYARR

SEQ ID NO: 901 - protein, 21 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDALNXFYAHH

SEQ ID NO: 902 - protein, 21 aa, Artificial Sequence
  Description of Artificial Sequence: Synthetic peptide
  N-term Ac
  MOD_RES (2)..(2): Cou
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQALRAIGDAFNAAYAHH

SEQ ID NO: 903 - protein, 21 aa, Artificial Sequence
  Description of Artificial Sequence: Synthetic peptide
  N-term Ac
  MOD_RES (2)..(2): Cou
  MOD_RES (16)..(16): 2-aminoisobutyric acid
  C-term NH2
IXIAQALRRIGDELNXFYAHH

SEQ ID NO: 904 - protein, 21 aa, Artificial Sequence
  Description of Artificial Sequence: Synthetic peptide
  N-term Ac
  MOD_RES (2)..(2): Cou
  C-term NH2
RXIAQALRRIGDEFNAFYAHH

SEQ ID NO: 905 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQALRAIGDAFNAFYXHH

SEQ ID NO: 906 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAFNXFYAHH

SEQ ID NO: 907 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IAIAFALRAIGDAFNXFYAHH

SEQ ID NO: 908 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQHLRAIGDAVNXFYAHH

SEQ ID NO: 909 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQHLRAIGDAVNXFYAHH

SEQ ID NO: 910 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQLLRAIGDAVNXFYAHH

SEQ ID NO: 911 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAVNXFYAHH

SEQ ID NO: 912 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQFLRAIGDAVNXFYAHH

SEQ ID NO: 913 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAHNXFYAHH

SEQ ID NO: 914 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAHLLRAIGDAVNXFYAHH

SEQ ID NO: 915 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAINXFYAHH

SEQ ID NO: 916 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAINXFYAHH

SEQ ID NO: 917 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IHIAQLLRAIGDAFNXFYAHH

SEQ ID NO: 918 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IHIAQLLRAIGDAVNXFYAHH

SEQ ID NO: 919 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAVNXFYAHA

SEQ ID NO: 920 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQLLRAIGDAVNXFYAAH

SEQ ID NO: 921 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALDAIGRAVNXFYAHH

SEQ ID NO: 922 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALDAIGDAVNXFYAHH

SEQ ID NO: 923 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALDAIGRAVNXFYAHH

SEQ ID NO: 924 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAARAIXDAVNXFYAHH

SEQ ID NO: 925 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALDAIGRAFNXFYAHH

SEQ ID NO: 926 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALDAIGDAFNXFYAHH

SEQ ID NO: 927 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (11)..(11): 2-aminoisobutyric acid
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQAARAIXDAFNXFYAHH

SEQ ID NO: 928 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQALDAIGRAFNAAYAHH

SEQ ID NO: 929 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAQALRAIGDAFNAAYAHH

SEQ ID NO: 930 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAAQLRAIGDAVNXFYAHH

SEQ ID NO: 931 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAAQLRAIGDAFNXFYAHH

SEQ ID NO: 932 - protein, 21 aa, Artificial Sequence
  Description of Artificial Sequence: Synthetic peptide
  N-term Ac
  MOD_RES (3)..(3): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWLAQLLRAIGDAFNXFYAHH

SEQ ID NO: 933 - protein, 21 aa, Artificial Sequence
  Description of Artificial Sequence: Synthetic peptide
  N-term Ac
  MOD_RES (3)..(3): Norleucine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWLAQLLRAIGDAVNXFYAHH

SEQ ID NO: 934 - protein, 21 aa, Artificial Sequence
  Description of Artificial Sequence: Synthetic peptide
  N-term Ac
  MOD_RES (3)..(3): Norleucine
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWLXQLLRAIGDAFNXFYAHH

SEQ ID NO: 935 - protein, 21 aa, Artificial Sequence
  Description of Artificial Sequence: Synthetic peptide
  N-term Ac
  MOD_RES (3)..(3): Norleucine
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWLXQLLRAIGDAVNXFYAHH

SEQ ID NO: 936 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IRIAQLLRAIGDAFNXFYAHH

SEQ ID NO: 937 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
ISIAQLLRAIGDAFNXFYAHH

SEQ ID NO: 938 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IRIXQLLRAIGDAFNXFYAHH

SEQ ID NO: 939 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
ISIXQLLRAIGDAFNXFYAHH

SEQ ID NO: 940 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALDAIGRAFNAYYARR

SEQ ID NO: 941 - protein, 20 aa, Artificial Sequence
  Description of Artificial Sequence: Synthetic peptide
  N-term Pr
  MOD_RES (3)..(3): 2-aminoisobutyric acid
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  MOD_RES (18)..(18): 2-aminoisobutyric acid
  C-term NH2
WIXQLLRAIGDAFNXFYXHH

SEQ ID NO: 942 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
IWIXQLLRAIGDAVNXFYXHH

SEQ ID NO: 943 - protein, 20 aa, Artificial Sequence
  Description of Artificial Sequence: Synthetic peptide
  N-term Pr
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  MOD_RES (18)..(18): 2-aminoisobutyric acid
  C-term NH2
WIAQLLRAIGDAVNXFYXHH

SEQ ID NO: 944 - protein, 20 aa, Artificial Sequence
  Description of Artificial Sequence: Synthetic peptide
  N-term Pr
  MOD_RES (3)..(3): 2-aminoisobutyric acid
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  MOD_RES (18)..(18): 2-aminoisobutyric acid
  C-term NH2
WIXQALRAIGDAFNXFYXHH

SEQ ID NO: 945 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
IWIXQALRAIGDAVNXFYXHH

SEQ ID NO: 946 - protein, 21 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
RWIXQALRAIGDAVNXFYXHH

SEQ ID NO: 947 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
IWIAQXLRAIGDAFNXFYXHH

SEQ ID NO: 948 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
IWIAQXLRAIGDAVNXFYXHH

SEQ ID NO: 949 - protein, 21 aa, Artificial Sequence
  Description of Artificial Sequence: Synthetic peptide
  N-term Ac
  MOD_RES (6)..(6): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
RWIAQXLRAIGDAVNXFYXHH

SEQ ID NO: 950 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (19)..(19): 2-aminoisobutyric acid
  C-term NH2
IWIAQALRAIGDAVNXFYXHH

SEQ ID NO: 951 - protein, 15 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
AIWIAQELRAIGDAF

SEQ ID NO: 952 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYAR

SEQ ID NO: 953 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDLFAAYYAR

SEQ ID NO: 954 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYAHH

SEQ ID NO: 955 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDLFAAYYAHH

SEQ ID NO: 956 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAAALRAIGDAFNAAYARR

SEQ ID NO: 957 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAAALRAIGDAFNAAYAHH

SEQ ID NO: 958 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAAALRAIGDAFNAAYAR

SEQ ID NO: 959 - protein, 20 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRAAGDAFNAYYAR

SEQ ID NO: 960 - protein, 21 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  C-term NH2
IWIAQALRAAGDAFNAYYAHH

SEQ ID NO: 961 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYARR

SEQ ID NO: 962 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): Norleucine
  MOD_RES (16)..(16): Alpha-Me S5-pentenyl-alanine olefin amino acid connected by an all-carbon crosslinker comprising one double bond
  C-term NH2
IWIAQALRAIGDLFNAYYARR

SEQ ID NO: 963 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IWIAQALRAIGDXFNAYYARR

SEQ ID NO: 964 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYAHH

SEQ ID NO: 965 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): Norleucine
  MOD_RES (16)..(16): Alpha-Me S5-pentenyl-alanine olefin amino acid connected by an all-carbon crosslinker comprising one double bond
  C-term NH2
IWIAQALRAIGDLFNAYYAHH

SEQ ID NO: 966 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IWIAQALRAIGDXFNAYYAHH

SEQ ID NO: 967 - protein, 20 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYAR

SEQ ID NO: 968 - protein, 21 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQQLRAIGDAFNXFYAHH

SEQ ID NO: 969 - protein, 21 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 970 - protein, 21 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQELRAIGDAFNXFYAHH

SEQ ID NO: 971 - protein, 21 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALDAIGRAFNXFYAHH

SEQ ID NO: 972 - protein, 21 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAAA

SEQ ID NO: 973 - protein, 19 aa, Artificial Sequence
  Description of Artificial Sequence: Synthetic peptide
  N-term Ac
  MOD_RES (2)..(2): Cou
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYA

SEQ ID NO: 974 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQALRAIGDAFNAAYAHH

SEQ ID NO: 975 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQQLRAIGDAFNAAYAHH

SEQ ID NO: 976 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDALNXFYAHH

SEQ ID NO: 977 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 978 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQQLRAIGDAFNXFYAHH

SEQ ID NO: 979 - protein, 21 aa, Artificial Sequence
  Description of Artificial Sequence: Synthetic peptide
  N-term Ac
  MOD_RES (9)..(9): Alpha-Me R-azide 1,5 triazole (3 carbon) amino acid
  MISC_FEATURE (9)..(13): Crosslink between residues
  MOD_RES (13)..(13): 2-amino-2-(pent-4-yn-1-yl)hept-6-ynoic acid after Ru-catalyzed cycloaddition
  MISC_FEATURE (13)..(17): Crosslink between residues
  MOD_RES (17)..(17): Alpha-Me azide 1,5 triazole (3 carbon) amino acid
  C-term NH2
RWIAQALRXIGDXFNAXYAHH

SEQ ID NO: 980 - protein, 21 aa, Artificial Sequence
  Description of Artificial Sequence: Synthetic peptide
  N-term Ac
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQALRAIGDAFNAAYAHH

SEQ ID NO: 981 - protein, 21 aa, Artificial Sequence
  Description of Artificial Sequence: Synthetic peptide
  N-term Ac
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQQLRAIGDAFNAAYAHH

SEQ ID NO: 982 - protein, 21 aa, Artificial Sequence
  Description of Artificial Sequence: Synthetic peptide
  N-term Ac
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDALNXFYAHH

SEQ ID NO: 983 - protein, 21 aa, Artificial Sequence
  Description of Artificial Sequence: Synthetic peptide
  N-term Ac
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 984 - protein, 21 aa, Artificial Sequence
  Description of Artificial Sequence: Synthetic peptide
  N-term Ac
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQQLRAIGDAFNXFYAHH

SEQ ID NO: 985 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXFYAAA

SEQ ID NO: 986 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQELRAIGDAFNXFYAHH

SEQ ID NO: 987 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IWIAQALRAIGAXFNAFYAHH

SEQ ID NO: 988 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXFYA

SEQ ID NO: 989 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IXIAAALRAIGDAFNAYYARR

SEQ ID NO: 990 - protein, 21 aa, Artificial Sequence
  Description of Artificial Sequence: Synthetic peptide
  N-term Ac
  MOD_RES (2)..(2): Diaminopropionic acid
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IXIAAALRAIGDAFNAYYARR

SEQ ID NO: 991 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IXIAAQLRAIGDAFNAYYARR

SEQ ID NO: 992 - protein, 21 aa, Artificial Sequence
  Description of Artificial Sequence: Synthetic peptide
  N-term Ac
  MOD_RES (2)..(2): Diaminopropionic acid
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IXIAAQLRAIGDAFNAYYARR

SEQ ID NO: 993 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAQQLRAIGDAFNAAYAHH

SEQ ID NO: 994 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IXIAQQLRAIGDAFNAAYAHH

SEQ ID NO: 995 - protein, 21 aa, Artificial Sequence
  Description of Artificial Sequence: Synthetic peptide
  N-term Ac
  MOD_RES (2)..(2): Diaminopropionic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IXIAQQLRAIGDAFNAAYAHH

SEQ ID NO: 996 - protein, 21 aa, Artificial Sequence
  Description of Artificial Sequence: Synthetic peptide
  N-term Ac
  MOD_RES (2)..(2): Diaminopropionic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQQLRAIGDAFNAAYAHH

SEQ ID NO: 997 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(7-(diethylamino)-2-oxo-2H-chromene-3- carboxamido)propanoic acid
  C-term NH2
IWIAQALRAIGDAFNXXYAHH

SEQ ID NO: 998 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(11-oxo-2,3,6,7-tetrahydro-1H,5H,11H-pyrano [2,3-f]pyrido[3,2,1-ij]quinoline-10-carboxamido)propanoic acid
  C-term NH2
IWIAQALRAIGDAFNXXYAHH

SEQ ID NO: 999 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): Diaminopropionic acid
  C-term NH2
IWIAQALRAIGDAFNXXYAHH

SEQ ID NO: 1000 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(7-(diethylamino)-2-oxo-2H-chromene-3- carboxamido)propanoic acid
  C-term NH2
IRIAQALRAIGDAFNXXYAHH

SEQ ID NO: 1001 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(11-oxo-2,3,6,7-tetrahydro-1H,5H,11H-pyrano [2,3-f]pyrido[3,2,1-ij]quinoline-10-carboxamido)propanoic acid
  C-term NH2
IRIAQALRAIGDAFNXXYAHH

SEQ ID NO: 1002 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): Diaminopropionic acid
  C-term NH2
IRIAQALRAIGDAFNXXYAHH

SEQ ID NO: 1003 - protein, 21 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(7-(diethylamino)-2-oxo-2H-chromene-3- carboxamido)propanoic acid
  C-term NH2
IXIAQALRAIGDAFNXXYAHH

SEQ ID NO: 1004 - protein, 21 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(11-oxo-2,3,6,7-tetrahydro-1H,5H,11H-pyrano [2,3-f]pyrido[3,2,1-ij]quinoline-10-carboxamido)propanoic acid
  C-term NH2
IXIAQALRAIGDAFNXXYAHH

SEQ ID NO: 1005 - protein, 21 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): Diaminopropionic acid
  C-term NH2
IXIAQALRAIGDAFNXXYAHH

SEQ ID NO: 1006 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFAXFYAHH

SEQ ID NO: 1007 - protein, 21 aa, Artificial Sequence
  Description of Artificial Sequence: Synthetic peptide
  N-term Ac
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFAXFYAHH

SEQ ID NO: 1008 - protein, 21 aa, Artificial Sequence
  Description of Artificial Sequence: Synthetic peptide
  N-term Ac
  MOD_RES (2)..(2): Diaminopropionic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFAXFYAHH

SEQ ID NO: 1009 - protein, 21 aa, Artificial Sequence
  Description of Artificial Sequence: Synthetic peptide
  N-term Pam
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFNXFYAHH

SEQ ID NO: 1010 - protein, 21 aa, Artificial Sequence
  Description of Artificial Sequence: Synthetic peptide
  N-term Pam
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 1011 - protein, 21 aa, Artificial Sequence
  Description of Artificial Sequence: Synthetic peptide
  N-term Pam
  MOD_RES (2)..(2): (S)-2-amino-3-(11-oxo-2,3,6,7-tetrahydro-1H,5H,11H-pyrano [2,3-f]pyrido[3,2,1-ij]quinoline-10-carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 1012 - protein, 21 aa, Artificial Sequence
  Description of Artificial Sequence: Synthetic peptide
  N-term Pam
  MOD_RES (2)..(2): Diaminopropionic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 1013 - protein, 21 aa, Artificial Sequence
  Description of Artificial Sequence: Synthetic peptide
  N-term Ac
  MOD_RES (9)..(9): Alpha-Me azide 1,5 triazole (3 carbon) amino acid
  MISC_FEATURE (9)..(13): Crosslink between residues
  MOD_RES (13)..(13): Alpha-Me alkyne 1,5 triazole (5 carbon) amino acid
  MOD_RES (16)..(16): 2-aminoisobutyric acid
  C-term NH2
IWIAQALRXIGDXFNXFYAHH

SEQ ID NO: 1014 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  MOD_RES (16)..(16): 2-aminoisobutyric acid
  C-term NH2
IWIAQALRXIGDXFNXFYAHH

SEQ ID NO: 1015 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYARR

SEQ ID NO: 1016 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQELRAIGDAFNXFYAHH

SEQ ID NO: 1017 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALDAIGRAFNXFYAHH

SEQ ID NO: 1018 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAAA

SEQ ID NO: 1019 - protein, 19 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYA

SEQ ID NO: 1020 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQQLRAIGDAFNXFYAHH

SEQ ID NO: 1021 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDAFNXFYAHH

SEQ ID NO: 1022 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQELRAIGDAFNXFYAHH

SEQ ID NO: 1023 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALDAIGRAFNXFYAHH

SEQ ID NO: 1024 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDAFNXFYAAA

SEQ ID NO: 1025 - protein, 19 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDAFNXFYA

SEQ ID NO: 1026 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IWIAQALRAIGAXFNAFYAHH

SEQ ID NO: 1027 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAAALRAIGDAFNAYYARR

SEQ ID NO: 1028 - protein, 20 aa, Artificial Sequence
  Description of Artificial Sequence: Synthetic peptide
  N-term Pr
  MOD_RES (1)..(1): (S)-2-amino-3-(7-(diethylamino)-2-oxo-2H-chromene-3- carboxamido)propanoic acid
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
XIAQALRAIGDAFNXFYAHH

SEQ ID NO: 1029 - protein, 20 aa, Artificial Sequence
  Description of Artificial Sequence: Synthetic peptide
  N-term Pr
  MOD_RES (1)..(1): (S)-2-amino-3-(7-(diethylamino)-2-oxo-2H-chromene-3- carboxamido)propanoic acid
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): 2-aminoisobutyric acid
  C-term NH2
XIAQALRAIGDAFNXFYQHH

SEQ ID NO: 1030 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQELRAIGDAFNXFYAHH

SEQ ID NO: 1031 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALDAIGRAFNXFYAHH

SEQ ID NO: 1032 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAFNXFYAAA

SEQ ID NO: 1033 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAFNXFYA

SEQ ID NO: 1034 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  C-term NH2
IXIAQALRRIGDEFNAYYAHH

SEQ ID NO: 1035 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQELRAIGDAFNXFYAHH

SEQ ID NO: 1036 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALDAIGRAFNXFYAHH

SEQ ID NO: 1037 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IXIAQALRAIGDAFNAAYAHH

SEQ ID NO: 1038 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQALRAIGDAFNAAYAHH

SEQ ID NO: 1039 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQALRAIGDAFNXFYAHH

SEQ ID NO: 1040 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIAQQLRAIGDAFNXFYAHH

SEQ ID NO: 1041 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDALNXFYAHH

SEQ ID NO: 1042 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid
  MISC_FEATURE (9)..(13): Crosslink between residues
  MOD_RES (13)..(13): Alpha-Me azide 1,5 triazole (3 carbon) amino acid
  MOD_RES (16)..(16): 2-aminoisobutyric acid
  C-term NH2
IWIAQALRXIGDXFNXFYAHH

SEQ ID NO: 1043 - protein, 21 aa, Artificial Sequence
  Description of Artificial Sequence: Synthetic peptide
  N-term Ac
  MOD_RES (9)..(9): unbridged alpha-Me R-azide (3 carbon) amino acid
  MOD_RES (13)..(13): 2-amino-2-(pent-4-yn-1-yl)hept-6-ynoic acid
  MOD_RES (17)..(17): unbridged alpha-Me azide (3 carbon) amino acid
  C-term NH2
RWIAQALRAIGDXFNAAYAHH

SEQ ID NO: 1044 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IXIAAALRAIGDAFNAYYARR

SEQ ID NO: 1045 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IXIAAQLRAIGDAFNAYYARR

SEQ ID NO: 1046 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IXIAAALRAIGDAFNAYYARR

SEQ ID NO: 1047 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IXIAAQLRAIGDAFNAYYARR

SEQ ID NO: 1048 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
RXIAQALRAIGDAFNAAYAHH

SEQ ID NO: 1049 - protein, 21 aa, Artificial Sequence
  Description of Artificial Sequence: Synthetic peptide
  N-term Ac
  MOD_RES (2)..(2): (S)-2-amino-3-(6,7-dimethoxy-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me R5-pentenyl-alanine olefin amino acid connected by an all-carbon crosslinker comprising one double bond
  C-term NH2
RXIAQALRAIGDAFNAAYAHH

SEQ ID NO: 1050 - protein, 21 aa, Artificial Sequence
  Description of Artificial Sequence: Synthetic peptide
  N-term Ac
  MOD_RES (2)..(2): (S)-2-amino-3-(7-hydroxy-2-oxo-2H-chromene-3-carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IXIAQQLRAIGDAFNAAYAHH

SEQ ID NO: 1051 - protein, 21 aa, Artificial Sequence
  Description of Artificial Sequence: Synthetic peptide
  N-term Ac
  MOD_RES (2)..(2): (S)-2-amino-3-(7-hydroxy-2-oxo-2H-chromene-3-carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQQLRAIGDAFNAAYAHH

SEQ ID NO: 1052 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(7-hydroxy-2-oxo-2H-chromene-3-carboxamido)propanoic acid
  C-term NH2
IWIAQALRAIGDAFNXXYAHH

SEQ ID NO: 1053 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): (S)-2-amino-3-(7-hydroxy-2-oxo-2H-chromene-3-carboxamido)propanoic acid
  C-term NH2
IRIAQALRAIGDAFNXXYAHH

SEQ ID NO: 1054 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IXIAQQLRAIGDAFNAAYAHH

SEQ ID NO: 1055 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
AAIAQALRAIGDAFNXFYAHH

SEQ ID NO: 1056 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
AAIAQALRAIGDAFNXFYA

SEQ ID NO: 1057 - protein, 23 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (23)..(23): D-amino acid
  C-term NH2
IWIAQALRAIGDAFNXFYAAAAA

SEQ ID NO: 1058 - protein, 22 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (22)..(22): D-amino acid
  C-term NH2
IWIAQALRAIGDAFNXAAAAAA

SEQ ID NO: 1059 - protein, 26 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (26)..(26): D-amino acid
  C-term NH2
IWIAQALRAIGDAFNXFYAHHAAAAA

SEQ ID NO: 1060 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALAAIGDAFNXFYAHH

SEQ ID NO: 1061 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIAQALRAIGDAFAXFYA

SEQ ID NO: 1062 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAFAXFYA

SEQ ID NO: 1063 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAFNXFYA

SEQ ID NO: 1064 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAFAXFYAHH

SEQ ID NO: 1065 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAFAAAAA

SEQ ID NO: 1066 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAFNAAAA

SEQ ID NO: 1067 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALLLRAIGDAFAXFYAHH

SEQ ID NO: 1068 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALLLRAIGDAFNXFYAHH

SEQ ID NO: 1069 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALLLRAIGDAFNXFYA

SEQ ID NO: 1070 - protein, 24 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  MOD_RES (24)..(24): D-amino acid
  C-term NH2
IWIALLLRAIGDAFNXFYAAAAAA

SEQ ID NO: 1071 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIALQLRAIGDAFNAAYAHH

SEQ ID NO: 1072 - protein, 19 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQQLRAIGDAFNAAYA

SEQ ID NO: 1073 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  MOD_RES (21)..(21): D-amino acid
  C-term NH2
RWIAQQLRAIGDAFNAAYAAA

SEQ ID NO: 1074 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  MOD_RES (21)..(21): D-amino acid
  C-term NH2
RWIALQLRAIGDAFNAAYAAA

SEQ ID NO: 1075 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIALQLRAIGDAFNAAYAHH

SEQ ID NO: 1076 - protein, 19 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQQLRAIGDAFNAAYA

SEQ ID NO: 1077 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  MOD_RES (21)..(21): D-amino acid
  C-term NH2
RXIAQQLRAIGDAFNAAYAAA

SEQ ID NO: 1078 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  MOD_RES (21)..(21): D-amino acid
  C-term NH2
RXIALQLRAIGDAFNAAYAAA

SEQ ID NO: 1079 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R-azide 1,5 triazole (3 carbon) amino acid
  MISC_FEATURE (9)..(13): Crosslink between residues
  MOD_RES (13)..(13): 2-amino-2-(pent-4-yn-1-yl)hept-6-ynoic acid after Ru-catalyzed cycloaddition
  MISC_FEATURE (13)..(17): Crosslink between residues
  MOD_RES (17)..(17): Alpha-Me azide 1,5 triazole (3 carbon) amino acid
  C-term NH2
RXIAQALRXIGDXFNAXYAHH

SEQ ID NO: 1080 - protein, 21 aa, Artificial Sequence
  Description of Artificial Sequence: Synthetic peptide
  MOD_RES (2)..(2): (S)-2-amino-3-(6,7-dimethoxy-2-oxo-2H-chromene-3- carboxamido)propanoic acid
  MOD_RES (9)..(9): Alpha-Me R-azide 1,5 triazole (3 carbon) amino acid
  MISC_FEATURE (9)..(13): Crosslink between residues
  MOD_RES (13)..(13): 2-amino-2-(pent-4-yn-1-yl)hept-6-ynoic acid after Ru-catalyzed cycloaddition
  MISC_FEATURE (13)..(17): Crosslink between residues
  MOD_RES (17)..(17): Alpha-Me azide 1,5 triazole (3 carbon) amino acid
  C-term NH2
RXIAQALRXIGDXFNAXYAHH

SEQ ID NO: 1081 - protein, 22 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R5-pentenyl-alanine olefin amino acid connected by an all-carbon crosslinker comprising one double bond
  MISC_FEATURE (10)..(14): Crosslink between residues
  MOD_RES (14)..(14): Two pentenyl-alanine olefin side chains, each of which is crosslinked to another amino acid as indicated
  MISC_FEATURE (14)..(18): Crosslink between residues
  MOD_RES (18)..(18): Alpha-Me S5-pentenyl-alanine olefin amino acid connected by an all-carbon crosslinker comprising one double bond
  C-term NH2
ARWIAQALRAIGDAFNAAYAHH

SEQ ID NO: 1082 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): 2-aminoisobutyric acid
  MOD_RES (13)..(13): 2-aminoisobutyric acid
  MOD_RES (17)..(17): 2-aminoisobutyric acid
  C-term NH2
RXIAQQLRXIGDXFNAXYAHH

SEQ ID NO: 1083 - protein, 21 aa, Artificial Sequence
  Description of Artificial Sequence: Synthetic peptide
  N-term Ac
  MOD_RES (9)..(9): 2-aminoisobutyric acid
  MOD_RES (13)..(13): 2-aminoisobutyric acid
  MOD_RES (17)..(17): 2-aminoisobutyric acid
  C-term NH2
RWIAQQLRXIGDXFNAXYAHH

SEQ ID NO: 1084 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RXIAQELRAIGDAFNAAYAHH

SEQ ID NO: 1085 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQELRAIGDAFNAAYAHH

SEQ ID NO: 1086 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IXIAQELRAIGDAFNAYYARR

SEQ ID NO: 1087 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid comprising a methyl at the 4-position
  MISC_FEATURE (9)..(13): Crosslink between residues
  MOD_RES (13)..(13): Alpha-Me azide 1,5 triazole (3 carbon) amino acid
  MOD_RES (16)..(16): 2-aminoisobutyric acid
  C-term NH2
IWIAQALRXIGDXFNXFYAHH

SEQ ID NO: 1088 - protein, 21 aa, Artificial Sequence
  Description of Artificial Sequence: Synthetic peptide
  N-term Ac
  MOD_RES (9)..(9): Alpha-Me alkyne 1,5 triazole (5 carbon) amino acid comprising a phenyl at the 4-position
  MISC_FEATURE (9)..(13): Crosslink between residues
  MOD_RES (13)..(13): Alpha-Me azide 1,5 triazole (3 carbon) amino acid
  MOD_RES (16)..(16): 2-aminoisobutyric acid
  C-term NH2
IWIAQALRXIGDXFNXFYAHH

SEQ ID NO: 1089 - protein, 21 aa, Artificial Sequence
  Description of Artificial Sequence: Synthetic peptide
  N-term Ac
  MOD_RES (1)..(1): Norleucine
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
LWIAQALRAIGDAFNAAYAHH

SEQ ID NO: 1090 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
KWIAQALRAIGDAFNAAYAHH

SEQ ID NO: 1091 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
RWIAQALRAIGDAFNAAYQHH

SEQ ID NO: 1092 - protein, 21 aa, Artificial Sequence
  Description of Artificial Sequence: Synthetic peptide
  N-term Ac
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IWIAQALRAIGDAFNAAYQHH

SEQ ID NO: 1093 - protein, 21 aa, Artificial Sequence
  Description of Artificial Sequence: Synthetic peptide
  N-term Ac
  MOD_RES (1)..(1): Norleucine
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
LXIAQALRAIGDAFNAAYAHH

SEQ ID NO: 1094 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
KXIAQALRAIGDAFNAAYAHH

SEQ ID NO: 1095 - protein, 21 aa, Artificial Sequence
  Description of Artificial Sequence: Synthetic peptide
  N-term Ac
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQELRRIGDEFAAYYARR

SEQ ID NO: 1096 - protein, 21 aa, Artificial Sequence
  Description of Artificial Sequence: Synthetic peptide
  N-term Ac
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IWIAQELRRIGDEFNAYYAAR

SEQ ID NO: 1097 - protein, 21 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
IWIAQELARIGDEFAAYYARR

SEQ ID NO: 1098 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQELRAIGDEFNAYYARR

SEQ ID NO: 1099 - protein, 21 aa, Artificial Sequence
  Description of Artificial Sequence: Synthetic peptide
  N-term Ac
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAQELRRIGDAFNAYYAAR

SEQ ID NO: 1100 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Two pentenyl-alanine olefin side chains, each of which is crosslinked to another amino acid as indicated
  MISC_FEATURE (6)..(13): Crosslink between residues
  MOD_RES (13)..(13): Alpha-Me S8-octenyl-alanine olefin amino acid connected by an all-carbon crosslinker comprising one double bond
  C-term NH2
IAIAQALRRIGDAFNAYYARR

SEQ ID NO: 1101 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IAIAQELRAIGDAFNAYYARR

SEQ ID NO: 1102 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIAQELRAIGDEFNAYYARR

SEQ ID NO: 1103 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Two pentenyl-alanine olefin side chains, each of which is crosslinked to another amino acid as indicated
  MISC_FEATURE (8)..(15): Crosslink between residues
  MOD_RES (15)..(15): Alpha-Me S8-octenyl-alanine olefin amino acid connected by an all-carbon crosslinker comprising one double bond
  C-term NH2
IWIAQELARIGDEFAAYYARR

SEQ ID NO: 1104 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IWIAAELRAIGDAFNAYYARR

SEQ ID NO: 1105 - protein, 21 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAELRAIGDAFNAYYARR

SEQ ID NO: 1106 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IWIAAELRAIGDEFNAYYARR

SEQ ID NO: 1107 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Two pentenyl-alanine olefin side chains, each of which is crosslinked to another amino acid as indicated
  MISC_FEATURE (13)..(20): Crosslink between residues
  MOD_RES (20)..(20): Alpha-Me S8-octenyl-alanine olefin amino acid connected by an all-carbon crosslinker comprising one double bond
  C-term NH2
IWIAQALRRIGDAFNAYYAAR

SEQ ID NO: 1108 - protein, 21 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Two pentenyl-alanine olefin side chains, each of which is crosslinked to another amino acid as indicated
  MISC_FEATURE (15)..(19): Crosslink between residues
  MOD_RES (19)..(19): Alpha-Me R5-pentenyl-alanine olefin amino acid connected by an all-carbon crosslinker comprising one double bond
  C-term NH2
IWIAQELARIGDEFAAYYARR

SEQ ID NO: 1109 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(20): Crosslink between residues
  MOD_RES (20)..(20): Alpha-Me S8-octenyl-alanine olefin amino acid connected by an all-carbon crosslinker comprising one double bond
  C-term NH2
IWIAQELRAIGDAFNAYYAAR

SEQ ID NO: 1110 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Two pentenyl-alanine olefin side chains, each of which is crosslinked to another amino acid as indicated
  MISC_FEATURE (16)..(20): Crosslink between residues
  MOD_RES (20)..(20): Alpha-Me R5-pentenyl-alanine olefin amino acid connected by an all-carbon crosslinker comprising one double bond
  C-term NH2
IWIAQELRAIGDEFNAYYAAR

SEQ ID NO: 1111 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYARR

SEQ ID NO: 1112 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IAIAQALRRIGDEFNAYYAAR

SEQ ID NO: 1113 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQELARIGDEFAAYYARR

SEQ ID NO: 1114 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IWIAQELARIGDEFNAYYAAR

SEQ ID NO: 1115 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAAELRAIGDEFAAYYARR

SEQ ID NO: 1116 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IWIAAELRAIGDEFNAYYAAR

SEQ ID NO: 1117 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQELRAIGDEFAAYYARR

SEQ ID NO: 1118 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IAIAQELRAIGDEFNAYYAAR

SEQ ID NO: 1119 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQALRRIGDAFAAYYARR

SEQ ID NO: 1120 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IWIAQALRRIGDAFNAYYAAR

SEQ ID NO: 1121 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
IAIAQALARIGDEFAAYYARR

SEQ ID NO: 1122 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDEFNAYYARR

SEQ ID NO: 1123 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IAIAQALRRIGDAFNAYYAAR

SEQ ID NO: 1124 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAQELARIGDAFNAYYAAR

SEQ ID NO: 1125 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAELRAIGDAFNAYYAAR

SEQ ID NO: 1126 - protein, 22 aa, Artificial Sequence
  Description of Artificial Sequence: Synthetic peptide
  N-term 5-FAM
  MOD_RES (1)..(1): Beta-Ala
  C-term NH2
AIWIAQELRRIGDEFNAYYARR

SEQ ID NO: 1127 - protein, 22 aa, Artificial Sequence
  Description of Artificial Sequence: Synthetic peptide
  N-term 5-FAM
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAQELRAIGDAFNAYYARR

SEQ ID NO: 1128 - protein, 26 aa, Artificial Sequence
  Description of Artificial Sequence: Synthetic peptide
  N-term 5-FAM
  MOD_RES (1)..(1): Beta-Ala
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (16)..(16): Norleucine
  MOD_RES (19)..(19): Alpha-Me S5-pentenyl-alanine olefin amino acid connected by an all-carbon crosslinker comprising one double bond
  C-term NH2
ANLWAAQRYGRELRALSDAFVDSFKK

SEQ ID NO: 1129 - protein, 22 aa, Artificial Sequence
  Description of Artificial Sequence: Synthetic peptide
  N-term 5-FAM
  MOD_RES (1)..(1): Beta-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
AKALETLRAVGDAVQRNHETAF

SEQ ID NO: 1130 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RXIAQALRAIGDAFNAFYARR

SEQ ID NO: 1131 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R-azide 1,5 triazole (3 carbon) amino acid
  MISC_FEATURE (9)..(13): Crosslink between residues
  MOD_RES (13)..(13): 2-amino-2-(pent-4-yn-1-yl)hept-6-ynoic acid after Ru-catalyzed cycloaddition
  MISC_FEATURE (13)..(17): Crosslink between residues
  MOD_RES (17)..(17): Alpha-Me azide 1,5 triazole (3 carbon) amino acid
  C-term NH2
RXIAQALRXIGDXFNAXYAHH

SEQ ID NO: 1132 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQELARIGDEFAAYYARR

SEQ ID NO: 1133 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQALRRIGDAFAAYYARR

SEQ ID NO: 1134 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IWIAQALRRIGDAFNAYYAAR

SEQ ID NO: 1135 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAQELARIGDAFNAYYAAR

SEQ ID NO: 1136 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAELRAIGDAFNAYYAAR

SEQ ID NO: 1137 - protein, 21 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  MISC_FEATURE (4)..(8): Crosslink between residues
  MOD_RES (8)..(8): Two pentenyl-alanine olefin side chains, each of which is crosslinked to another amino acid as indicated
  MISC_FEATURE (8)..(15): Crosslink between residues
  MOD_RES (15)..(15): Alpha-Me S8-octenyl-alanine olefin amino acid connected by an all-carbon crosslinker comprising one double bond
  C-term NH2
IWIAQELARIGDEFAAYYARR

SEQ ID NO: 1138 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Two pentenyl-alanine olefin side chains, each of which is crosslinked to another amino acid as indicated
  MISC_FEATURE (13)..(20): Crosslink between residues
  MOD_RES (20)..(20): Alpha-Me S8-octenyl-alanine olefin amino acid connected by an all-carbon crosslinker comprising one double bond
  C-term NH2
IWIAQALRRIGDAFNAYYAAR

SEQ ID NO: 1139 - protein, 21 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Two pentenyl-alanine olefin side chains, each of which is crosslinked to another amino acid as indicated
  MISC_FEATURE (15)..(19): Crosslink between residues
  MOD_RES (19)..(19): Alpha-Me R5-pentenyl-alanine olefin amino acid connected by an all-carbon crosslinker comprising one double bond
  C-term NH2
IWIAQELARIGDEFAAYYARR

SEQ ID NO: 1140 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQELRAIGDEFAAYYARR

SEQ ID NO: 1141 - protein, 21 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRRIGDAFNAYYARR

SEQ ID NO: 1142 - protein, 21 aa, Artificial Sequence
  Description of Artificial Sequence: Synthetic peptide
  N-term Ac
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IWIAQELRRIGDEFAAYYARR

SEQ ID NO: 1143 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1144 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
WIAQALRAIGDAFNAYYA

SEQ ID NO: 1145 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYYA

SEQ ID NO: 1146 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAAALRAIGDAFNAYYA

SEQ ID NO: 1147 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALAAIGDAFNAYYA

SEQ ID NO: 1148 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIADAFNAYYA

SEQ ID NO: 1149 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAANAYYA

SEQ ID NO: 1150 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFAAYYA

SEQ ID NO: 1151 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAAYA

SEQ ID NO: 1152 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYAA

SEQ ID NO: 1153 - protein, 19 aa, Artificial Sequence
  Description of Artificial Sequence: Synthetic peptide
  N-term Ac
  C-term NH2
IAQALRRIGDEFNAYYAHH

SEQ ID NO: 1154 - protein, 19 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAYYAHH

SEQ ID NO: 1155 - protein, 21 aa, Artificial Sequence
  Description of Artificial Sequence: Synthetic peptide
  N-term Ac
  C-term NH2
IWIAQALRRIGDEFNAYYAHH

SEQ ID NO: 1156 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYYAHH

SEQ ID NO: 1157 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IAIAQALRAIGDAFNAYYAHH

SEQ ID NO: 1158 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  C-term NH2
IAQALRRIGDEFNAYYAHH

SEQ ID NO: 1159 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAYYAHH

SEQ ID NO: 1160 - protein, 19 aa, Artificial Sequence
  Description of Artificial Sequence: Synthetic peptide
  N-term heptenoic acid crosslinked with position 3 via an all-carbon crosslinker comprising one double bond
  MOD_RES (3)..(3): Alpha-Me S5-pentenyl-alanine olefin amino acid connected by an all-carbon crosslinker comprising one double bond
  C-term NH2
IAAALRRIGDEFNAYYAHH

SEQ ID NO: 1161 - protein, 19 aa, Artificial Sequence
  Description of Artificial Sequence: Synthetic peptide
  N-term heptenoic acid crosslinked with position 3 via an all-carbon crosslinker comprising one double bond
  MOD_RES (3)..(3): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAAALRAIGDAFNAYYAHH

SEQ ID NO: 1162 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYAAA

SEQ ID NO: 1163 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYAA

SEQ ID NO: 1164 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAAALRRIGDEFAAYYAA

SEQ ID NO: 1165 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAVALRRIGDEFAAYYAA

SEQ ID NO: 1166 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRRIGDEFAAYYAA

SEQ ID NO: 1167 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAIALRRIGDEFAAYYAA

SEQ ID NO: 1168 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAFALRRIGDEFAAYYAA

SEQ ID NO: 1169 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAYALRRIGDEFAAYYAA

SEQ ID NO: 1170 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAGALRRIGDEFAAYYAA

SEQ ID NO: 1171 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDAFAAYYAA

SEQ ID NO: 1172 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDXFAAYYAA

SEQ ID NO: 1173 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYAA

SEQ ID NO: 1174 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDXFAAYYAA

SEQ ID NO: 1175 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDLFAAYYAA

SEQ ID NO: 1176 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDXFAAYYAA

SEQ ID NO: 1177 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDLFAAYYAA

SEQ ID NO: 1178 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDEFNAYYA

SEQ ID NO: 1179 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAAALRAIGDEFNAYYA

SEQ ID NO: 1180 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAVALRAIGDEFNAYYA

SEQ ID NO: 1181 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYA

SEQ ID NO: 1182 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAIALRAIGDEFNAYYA

SEQ ID NO: 1183 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDEFNAYYA

SEQ ID NO: 1184 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDEFNAYYA

SEQ ID NO: 1185 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAGALRAIGDEFNAYYA

SEQ ID NO: 1186 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYA

SEQ ID NO: 1187 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): Norleucine
  MOD_RES (16)..(16): Alpha-Me S5-pentenyl-alanine olefin amino acid connected by an all-carbon crosslinker comprising one double bond
  C-term NH2
IAIAQALRAIGDLFNAYYA

SEQ ID NO: 1188 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IAIAQALRAIGDXFNAYYA

SEQ ID NO: 1189 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAELRAIGDAFNAYYAAA

SEQ ID NO: 1190 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAALRAIGDAFNAYYAAA

SEQ ID NO: 1191 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAVLRAIGDAFNAYYAAA

SEQ ID NO: 1192 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAALLRAIGDAFNAYYAAA

SEQ ID NO: 1193 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAILRAIGDAFNAYYAAA

SEQ ID NO: 1194 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAFLRAIGDAFNAYYAAA

SEQ ID NO: 1195 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAYLRAIGDAFNAYYAAA

SEQ ID NO: 1196 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAGLRAIGDAFNAYYAAA

SEQ ID NO: 1197 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAASLRAIGDAFNAYYAAA

SEQ ID NO: 1198 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYA

SEQ ID NO: 1199 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAELRAIGDAFNAYYAA

SEQ ID NO: 1200 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
WIAQALRAIGDAFNAYYA

SEQ ID NO: 1201 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYYA

SEQ ID NO: 1202 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAAALRAIGDAFNAYYA

SEQ ID NO: 1203 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALAAIGDAFNAYYA

SEQ ID NO: 1204 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIADAFNAYYA

SEQ ID NO: 1205 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAANAYYA

SEQ ID NO: 1206 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFAAYYA

SEQ ID NO: 1207 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAAYA

SEQ ID NO: 1208 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYAA

SEQ ID NO: 1209 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDAFNAYYA

SEQ ID NO: 1210 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IAIALALRAIGDAFNAYYAAA

SEQ ID NO: 1211 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IWIAAALRAIGDAFNAYYAAA

SEQ ID NO: 1212 - protein, 19 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IWIAAALRAIGDAFNAYYA

SEQ ID NO: 1213 - protein, 19 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (13)..(13): Norleucine
  MOD_RES (16)..(16): Alpha-Me S8-octenyl-alanine olefin amino acid connected by an all-carbon crosslinker comprising one double bond
  C-term NH2
IWIAAALRAIGDLFNAYYA

SEQ ID NO: 1214 - protein, 19 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIALALRAIGDAFNAYYA

SEQ ID NO: 1215 - protein, 19 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me R5-pentenyl-alanine olefin amino acid connected by an all-carbon crosslinker comprising one double bond
  C-term NH2
IAIALALRAIGDAFNAYYA

SEQ ID NO: 1216 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAFNAYYA

SEQ ID NO: 1217 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYYA

SEQ ID NO: 1218 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAAALRXIGDXFAAYYAA

SEQ ID NO: 1219 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRXIGDXFAAYYAA

SEQ ID NO: 1220 - protein, 20 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRAIGDAFAAYYAA

SEQ ID NO: 1221 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIAQELRAIGDAFNAYYARR

SEQ ID NO: 1222 - protein, 19 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIAQALRAIGDAFNAYYA

SEQ ID NO: 1223 - protein, 19 aa, Artificial Sequence
  Description of Artificial Sequence: Synthetic peptide
  N-term HBS
  MOD_RES (3)..(3): N-allyl alanine after metathesis cyclization
  C-term NH2
IAAALRRIGDEFNAYYAHH

SEQ ID NO: 1224 - protein, 19 aa, Artificial Sequence
  Description of Artificial Sequence: Synthetic peptide
  N-term HBS
  MOD_RES (3)..(3): N-allyl alanine after metathesis cyclization
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAAALRAIGDAFNAYYAHH

SEQ ID NO: 1225 - protein, 21 aa, Artificial Sequence
  Description of Artificial Sequence: Synthetic peptide
  N-term HBS
  MOD_RES (3)..(3): N-allyl alanine after metathesis cyclization
  C-term NH2
IWAAQALRRIGDEFNAYYAHH

SEQ ID NO: 1226 - protein, 21 aa, Artificial Sequence
  Description of Artificial Sequence: Synthetic peptide
  N-term HBS
  MOD_RES (3)..(3): N-allyl alanine after metathesis cyclization
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWAAQALRAIGDAFNAYYAHH

SEQ ID NO: 1227 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  C-term NH2
IAQALRRIGDEFNAYYAHH

SEQ ID NO: 1228 - protein, 19 aa, Artificial Sequence
  Description of Artificial Sequence: Synthetic peptide
  N-term heptenoic acid crosslinked with position 4 via an all-carbon crosslinker comprising one double bond
  MOD_RES (4)..(4): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAQALRAIGDAFNAYYAHH

SEQ ID NO: 1229 - protein, 19 aa, Artificial Sequence
  Description of Artificial Sequence: Synthetic peptide
  N-term heptenoic acid crosslinked with position 3 via an all-carbon crosslinker comprising one double bond
  MOD_RES (3)..(3): Alpha-Me S5-pentenyl-alanine olefin amino acid connected by an all-carbon crosslinker comprising one double bond
  MOD_RES (7)..(7): Alpha-Me S5-pentenyl-alanine olefin amino acid connected by an all-carbon crosslinker comprising one double bond
  MISC_FEATURE (7)..(11): Crosslink between residues
  MOD_RES (11)..(11): Alpha-Me S5-pentenyl-alanine olefin amino acid connected by an all-carbon crosslinker comprising one double bond
  C-term NH2
IAAALRAIGDAFNAYYAHH

SEQ ID NO: 1230 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDEFNAYYA

SEQ ID NO: 1231 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAAALRAIGDEFNAYYA

SEQ ID NO: 1232 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAVALRAIGDEFNAYYA

SEQ ID NO: 1233 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAVALRAIGDEFNAYYA

SEQ ID NO: 1234 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAIALRAIGDEFNAYYA

SEQ ID NO: 1235 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAIALRAIGDEFNAYYA

SEQ ID NO: 1236 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDEFNAYYA

SEQ ID NO: 1237 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYA

SEQ ID NO: 1238 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYA

SEQ ID NO: 1239 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDEFNAYYA

SEQ ID NO: 1240 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDEFNAYYA

SEQ ID NO: 1241 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYA

SEQ ID NO: 1242 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): Norleucine
  MOD_RES (16)..(16): Alpha-Me S5-pentenyl-alanine olefin amino acid connected by an all-carbon crosslinker comprising one double bond
  C-term NH2
IAIAQALRAIGDLFNAYYA

SEQ ID NO: 1243 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (13)..(13): 2-aminoisobutyric acid
  MOD_RES (16)..(16): Alpha-Me S5-pentenyl-alanine olefin amino acid connected by an all-carbon crosslinker comprising one double bond
  C-term NH2
IAIAQALRAIGDXFNAYYA

SEQ ID NO: 1244 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRRIGDEFAAYYA

SEQ ID NO: 1245 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAAALRRIGDEFAAYYA

SEQ ID NO: 1246 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAVALRRIGDEFAAYYA

SEQ ID NO: 1247 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRRIGDEFAAYYA

SEQ ID NO: 1248 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAIALRRIGDEFAAYYA

SEQ ID NO: 1249 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAFALRRIGDEFAAYYA

SEQ ID NO: 1250 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAYALRRIGDEFAAYYA

SEQ ID NO: 1251 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAGALRRIGDEFAAYYA

SEQ ID NO: 1252 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDAFAAYYA

SEQ ID NO: 1253 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDXFAAYYA

SEQ ID NO: 1254 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYA

SEQ ID NO: 1255 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDXFAAYYA

SEQ ID NO: 1256 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDLFAAYYA

SEQ ID NO: 1257 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDXFAAYYA

SEQ ID NO: 1258 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDLFAAYYA

SEQ ID NO: 1259 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAALRAIGDAFNAYYAA

SEQ ID NO: 1260 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAVLRAIGDAFNAYYAA

SEQ ID NO: 1261 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAALLRAIGDAFNAYYAA

SEQ ID NO: 1262 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAILRAIGDAFNAYYAA

SEQ ID NO: 1263 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAFLRAIGDAFNAYYAA

SEQ ID NO: 1264 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAYLRAIGDAFNAYYAA

SEQ ID NO: 1265 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAGLRAIGDAFNAYYAA

SEQ ID NO: 1266 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAASLRAIGDAFNAYYAA

SEQ ID NO: 1267 - protein, 21 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): Alpha-Me S5-pentenyl-alanine olefin amino acid connected by an all-carbon crosslinker comprising one double bond
  MISC_FEATURE (16)..(20): Crosslink between residues
  MOD_RES (20)..(20): Alpha-Me S5-pentenyl-alanine olefin amino acid connected by an all-carbon crosslinker comprising one double bond
  C-term NH2
IAIALALRAIGDAFNAYYAAA

SEQ ID NO: 1268 - protein, 19 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (13)..(13): Norleucine
  MOD_RES (16)..(16): Alpha-Me R8-octenyl-alanine olefin amino acid connected by an all-carbon crosslinker comprising one double bond
  C-term NH2
IWIAAALRAIGDLFNAYYA

SEQ ID NO: 1269 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDAFNAYYA

SEQ ID NO: 1270 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me R5-pentenyl-alanine olefin amino acid connected by an all-carbon crosslinker comprising one double bond
  MISC_FEATURE (9)..(13): Crosslink between residues
  MOD_RES (13)..(13): Two pentenyl-alanine olefin side chains, each of which is crosslinked to another amino acid as indicated
  MISC_FEATURE (13)..(17): Crosslink between residues
  MOD_RES (17)..(17): Alpha-Me S5-pentenyl-alanine olefin amino acid connected by an all-carbon crosslinker comprising one double bond
  C-term NH2
IXIAQALRAIGDAFNAAYAHH

SEQ ID NO: 1271 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDAFAAYYA

SEQ ID NO: 1272 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDXFAAYYA

SEQ ID NO: 1273 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRAIGDXFAAYYA

SEQ ID NO: 1274 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYA

SEQ ID NO: 1275 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYA

SEQ ID NO: 1276 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDXFAAYYA

SEQ ID NO: 1277 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDXFAAYYA

SEQ ID NO: 1278 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDLFAAYYA

SEQ ID NO: 1279 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): Norleucine
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDLFAAYYA

SEQ ID NO: 1280 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDXFAAYYA

SEQ ID NO: 1281 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Norleucine
  MOD_RES (13)..(13): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRLIGDXFAAYYA

SEQ ID NO: 1282 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAVLRAIGDAFNAYYAA

SEQ ID NO: 1283 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAALLRAIGDAFNAYYAA

SEQ ID NO: 1284 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAFLRAIGDAFNAYYAA

SEQ ID NO: 1285 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAASLRAIGDAFNAYYAA

SEQ ID NO: 1286 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAELRAIGDAFNAYYAA

SEQ ID NO: 1287 - protein, 20 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAALRAIGDAFNAYYAA

SEQ ID NO: 1288 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAAALRRIGDEFAAYYA

SEQ ID NO: 1289 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAAALRRIGDEFAAYYA

SEQ ID NO: 1290 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRRIGDEFAAYYARR

SEQ ID NO: 1291 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYARR

SEQ ID NO: 1292 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRXIGDAFAAYYARR

SEQ ID NO: 1293 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRRIGDEFAAYYAR

SEQ ID NO: 1294 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYAR

SEQ ID NO: 1295 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRXIGDAFAAYYAR

SEQ ID NO: 1296 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDEFNAYYARR

SEQ ID NO: 1297 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYARR

SEQ ID NO: 1298 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDEFNAYYARR

SEQ ID NO: 1299 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDEFNAYYAR

SEQ ID NO: 1300 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDEFNAYYAR

SEQ ID NO: 1301 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYAR

SEQ ID NO: 1302 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDEFNAYYAR

SEQ ID NO: 1303 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAALRAIGDAFNAYYAAR

SEQ ID NO: 1304 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIALALRAIGDEFNAYYARR

SEQ ID NO: 1305 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAYALRAIGDEFNAYYARR

SEQ ID NO: 1306 - protein, 20 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYAR

SEQ ID NO: 1307 - protein, 20 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIALALRAIGDEFNAYYAR

SEQ ID NO: 1308 - protein, 20 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAYALRAIGDEFNAYYAR

SEQ ID NO: 1309 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAFNAYYARR

SEQ ID NO: 1310 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAYALRAIGDAFNAYYARR

SEQ ID NO: 1311 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAFNAYYAR

SEQ ID NO: 1312 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAYALRAIGDAFNAYYAR

SEQ ID NO: 1313 - protein, 20 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAFNAYYAH

SEQ ID NO: 1314 - protein, 19 aa, Artificial Sequence
  Description of Artificial Sequence: Synthetic peptide
  N-term Ac
  MOD_RES (9)..(9): reduced alpha-Me R8-octenyl-alanine olefin amino acid connected by an all-carbon crosslinker comprising one double bond
  MISC_FEATURE (9)..(16): Crosslink between residues
  MOD_RES (16)..(16): Modified alanine amino acid connected by a reduced olefin crosslinker
  C-term NH2
IWIAQALRAIGDAFNAYYA

SEQ ID NO: 1315 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRRIGDEFAAYYARR

SEQ ID NO: 1316 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRRIGDEFAAYYAR

SEQ ID NO: 1317 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIAQALRXIGDAFAAYYAR

SEQ ID NO: 1318 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): 2-aminoisobutyric acid
  MOD_RES (15)..(15): Alpha-Me S5-pentenyl-alanine olefin amino acid connected by an all-carbon crosslinker comprising one double bond
  MISC_FEATURE (15)..(19): Crosslink between residues
  MOD_RES (19)..(19): Alpha-Me S5-pentenyl-alanine olefin amino acid connected by an all-carbon crosslinker comprising one double bond
  C-term NH2
IAIALALRXIGDAFAAYYAR

SEQ ID NO: 1319 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDEFNAYYARR

SEQ ID NO: 1320 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYARR

SEQ ID NO: 1321 - protein, 21 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Alpha-Me R8-octenyl-alanine olefin amino acid connected by an all-carbon crosslinker comprising one double bond
  MISC_FEATURE (13)..(20): Crosslink between residues
  MOD_RES (20)..(20): Alpha-Me S5-pentenyl-alanine olefin amino acid connected by an all-carbon crosslinker comprising one double bond
  C-term NH2
IWIAAALRAIGDAFNAYYAAR

SEQ ID NO: 1322 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDEFNAYYAR

SEQ ID NO: 1323 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDEFNAYYAR

SEQ ID NO: 1324 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDEFNAYYAR

SEQ ID NO: 1325 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYARR

SEQ ID NO: 1326 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDAFNAYYARR

SEQ ID NO: 1327 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDAFNAYYARR

SEQ ID NO: 1328 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDAFNAYYARR

SEQ ID NO: 1329 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYAR

SEQ ID NO: 1330 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDAFNAYYAR

SEQ ID NO: 1331 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDAFNAYYAR

SEQ ID NO: 1332 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDAFNAYYAR

SEQ ID NO: 1333 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYA

SEQ ID NO: 1334 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFNAYYA

SEQ ID NO: 1335 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDEFNAYYA

SEQ ID NO: 1336 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDQFNAYYA

SEQ ID NO: 1337 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYA

SEQ ID NO: 1338 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFAAYYA

SEQ ID NO: 1339 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFAAYYA

SEQ ID NO: 1340 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFAAYYA

SEQ ID NO: 1341 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAFNAYYA

SEQ ID NO: 1342 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDQFNAYYA

SEQ ID NO: 1343 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDAFNAYYA

SEQ ID NO: 1344 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDQFNAYYA

SEQ ID NO: 1345 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDAFNAYYA

SEQ ID NO: 1346 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDQFNAYYA

SEQ ID NO: 1347 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1348 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQANAYYA

SEQ ID NO: 1349 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAINAYYA

SEQ ID NO: 1350 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQINAYYA

SEQ ID NO: 1351 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAANAYYA

SEQ ID NO: 1352 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADAFNAYYA

SEQ ID NO: 1353 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADQFNAYYA

SEQ ID NO: 1354 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1355 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDQFNAYYA

SEQ ID NO: 1356 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDAFNAYYA

SEQ ID NO: 1357 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDQFNAYYA

SEQ ID NO: 1358 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1359 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDQFNAYYA

SEQ ID NO: 1360 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYA

SEQ ID NO: 1361 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALAAIGDAFNAYYA

SEQ ID NO: 1362 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGNAFNAYYA

SEQ ID NO: 1363 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1364 - protein, 20 aa, Artificial Sequence
  Description of Artificial Sequence: Synthetic peptide
  N-term FITC
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDAFNAYYA

SEQ ID NO: 1365 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDAFNAYYA

SEQ ID NO: 1366 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDEFNAYYA

SEQ ID NO: 1367 - protein, 14 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  MISC_FEATURE (8)..(12): Crosslink between residues
  MOD_RES (12)..(12): Alpha-Me S5-pentenyl-alanine olefin amino acid connected by an all-carbon crosslinker comprising one double bond
  C-term NH2
WLAQLLRAIGDAIN

SEQ ID NO: 1368 - protein, 19 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IXIALALRAIGDAFNAYYA

SEQ ID NO: 1369 - protein, 19 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IXIALALRAIGDAFNXFYA

SEQ ID NO: 1370 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDAFNAYYARR

SEQ ID NO: 1371 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDAFNAYYARR

SEQ ID NO: 1372 - protein, 21 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDAFNAYYARR

SEQ ID NO: 1373 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYAR

SEQ ID NO: 1374 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAYALRAIGDAFNAYYAR

SEQ ID NO: 1375 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIALALRAIGDAFNAYYAR

SEQ ID NO: 1376 - protein, 20 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAFALRAIGDAFNAYYAR

SEQ ID NO: 1377 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYA

SEQ ID NO: 1378 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYA

SEQ ID NO: 1379 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFNAYYA

SEQ ID NO: 1380 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDEFNAYYA

SEQ ID NO: 1381 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDQFNAYYA

SEQ ID NO: 1382 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYA

SEQ ID NO: 1383 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFAAYYA

SEQ ID NO: 1384 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAFNAYYA

SEQ ID NO: 1385 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDQFNAYYA

SEQ ID NO: 1386 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDAFNAYYA

SEQ ID NO: 1387 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDQFNAYYA

SEQ ID NO: 1388 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDAFNAYYA

SEQ ID NO: 1389 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDQFNAYYA

SEQ ID NO: 1390 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1391 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAINAYYA

SEQ ID NO: 1392 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQINAYYA

SEQ ID NO: 1393 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAANAYYA

SEQ ID NO: 1394 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADAFNAYYA

SEQ ID NO: 1395 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADQFNAYYA

SEQ ID NO: 1396 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1397 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDQFNAYYA

SEQ ID NO: 1398 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDAFNAYYA

SEQ ID NO: 1399 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDQFNAYYA

SEQ ID NO: 1400 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1401 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDQFNAYYA

SEQ ID NO: 1402 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALAAIGDAFNAYYA

SEQ ID NO: 1403 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGNAFNAYYA

SEQ ID NO: 1404 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1405 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGDAVNAYYA

SEQ ID NO: 1406 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGDAINAYYA

SEQ ID NO: 1407 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGNAVNAYYA

SEQ ID NO: 1408 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGNAINAYYA

SEQ ID NO: 1409 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAVNAYYA

SEQ ID NO: 1410 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAINAYYA

SEQ ID NO: 1411 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGNAVNAYYA

SEQ ID NO: 1412 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGNAINAYYA

SEQ ID NO: 1413 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAVNAFYA

SEQ ID NO: 1414 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAVNAYYA

SEQ ID NO: 1415 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAVNXFYA

SEQ ID NO: 1416 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
IWIALALRAIGDAVNXYYA

SEQ ID NO: 1417 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWFALALRAIGDAFNAYYA

SEQ ID NO: 1418 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWYALALRAIGDAFNAYYA

SEQ ID NO: 1419 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWVALALRAIGDAFNAYYA

SEQ ID NO: 1420 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWLALALRAIGDAFNAYYA

SEQ ID NO: 1421 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAVNAYYA

SEQ ID NO: 1422 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAINAYYA

SEQ ID NO: 1423 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAINAYYA

SEQ ID NO: 1424 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALLLRAIGDAVNAYYA

SEQ ID NO: 1425 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALLLRAIGDAINAYYA

SEQ ID NO: 1426 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGDAFNAYYA

SEQ ID NO: 1427 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALSAIGDAFNAYYA

SEQ ID NO: 1428 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALHAIGDAFNAYYA

SEQ ID NO: 1429 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAFNAYYA

SEQ ID NO: 1430 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALAIGAIGDAVNAYYA

SEQ ID NO: 1431 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALAIGAIGDAINAYYA

SEQ ID NO: 1432 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALAINAIGDAVNAYYA

SEQ ID NO: 1433 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALAINAIGDAINAYYA

SEQ ID NO: 1434 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAVNAYYAHH

SEQ ID NO: 1435 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAINAYYAHH

SEQ ID NO: 1436 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGNAVNAYYAHH

SEQ ID NO: 1437 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGNAINAYYAHH

SEQ ID NO: 1438 - protein, 19 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALGAIGDAVNAYYA

SEQ ID NO: 1439 - protein, 19 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALGAIGDAINAYYA

SEQ ID NO: 1440 - protein, 19 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALGAIGNAVNAYYA

SEQ ID NO: 1441 - protein, 19 aa, Artificial Sequence
  Description of Artificial Sequence: Synthetic peptide
  N-term Ac
  MOD_RES (5)..(5): Alpha-Me R5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIAAALGAIGNAINAYYA

SEQ ID NO: 1442 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAVNAAAA

SEQ ID NO: 1443 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGDAVNAAAA

SEQ ID NO: 1444 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALDAIGDAVNAAAA

SEQ ID NO: 1445 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAVNAAAA

SEQ ID NO: 1446 - protein, 15 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALRAIGDAVN

SEQ ID NO: 1447 - protein, 15 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALGAIGDAVN

SEQ ID NO: 1448 - protein, 15 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALDAIGDAVN

SEQ ID NO: 1449 - protein, 15 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
IWIALALNAIGDAVN

SEQ ID NO: 1450 - protein, 20 aa, Artificial Sequence
  Description of Artificial Sequence: Synthetic peptide
  N-term 5-FAM
  MOD_RES (1)..(1): Beta-Ala
  MOD_RES (6)..(6): Alpha-Me R5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAAALGAIGDAVNAYYA

SEQ ID NO: 1451 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
AIWIALALRAIGDAFNXFYA

SEQ ID NO: 1452 - protein, 20 aa, Artificial Sequence
  Description of Artificial Sequence: Synthetic peptide
  N-term 5-FAM
  MOD_RES (1)..(1): Beta-Ala
  MOD_RES (6)..(6): Alpha-Me R5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAAALGAIGNAINAYYA

SEQ ID NO: 1453 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIALALGAIGNAINAYYA

SEQ ID NO: 1454 - protein, 20 aa, Artificial Sequence
  Description of Artificial Sequence: Synthetic peptide
  N-term FITC
  MOD_RES (1)..(1): Beta-Ala
  MOD_RES (6)..(6): Alpha-Me R5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAAALGAIGDAVNAYYA

SEQ ID NO: 1455 - protein, 20 aa, Artificial Sequence
  Description of Artificial Sequence: Synthetic peptide
  N-term FITC
  MOD_RES (1)..(1): Beta-Ala
  MOD_RES (10)..(10): Alpha-Me S5-pentenyl-alanine olefin amino acid connected by an all-carbon crosslinker comprising one double bond
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
AIWIALALRAIGDAFNXFYA

SEQ ID NO: 1456 - protein, 20 aa, Artificial Sequence
  Description of Artificial Sequence: Synthetic peptide
  N-term 5-FAM
  MOD_RES (1)..(1): Beta-Ala
  MOD_RES (6)..(6): Alpha-Me R5-pentenyl-alanine olefin amino acid connected by an all-carbon crosslinker comprising one double bond
  MISC_FEATURE (6)..(10): Crosslink between residues
  MOD_RES (10)..(10): Two pentenyl-alanine olefin side chains, each of which is crosslinked to another amino acid as indicated
  MISC_FEATURE (10)..(14): Crosslink between residues
  MOD_RES (14)..(14): Alpha-Me S5-pentenyl-alanine olefin amino acid connected by an all-carbon crosslinker comprising one double bond
  C-term NH2
AIWIAAALGAIGDAINAYYA

SEQ ID NO: 1457 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFAAYYA

SEQ ID NO: 1458 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  C-term NH2
RWIAQALRAIGDALNAFYAHH

SEQ ID NO: 1459 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQELRAIGDALNXFYAHH

SEQ ID NO: 1460 - protein, 19 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDALNXFYA

SEQ ID NO: 1461 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAARAIGDALNXFYAHH

SEQ ID NO: 1462 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALAAIGDALNXFYAHH

SEQ ID NO: 1463 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGNALNXFYAHH

SEQ ID NO: 1464 - protein, 21 aa, Artificial Sequence
  Description of Artificial Sequence: Synthetic peptide
  N-term Ac
  MOD_RES (8)..(8): Cit
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALXAIGDALNXFYAHH

SEQ ID NO: 1465 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDAANXFYAHH

SEQ ID NO: 1466 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQAARAIGDALNXFYAHH

SEQ ID NO: 1467 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALAAIGDALNXFYAHH

SEQ ID NO: 1468 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGNALNXFYAHH

SEQ ID NO: 1469 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (8)..(8): Cit
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALXAIGDALNXFYAHH

SEQ ID NO: 1470 - protein, 19 aa, Artificial Sequence
  Description of Artificial Sequence: Synthetic peptide
  N-term Ac
  MOD_RES (5)..(5): Methionine sulfoxide
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAMALXAIGDAFNAYYA

SEQ ID NO: 1471 - protein, 19 aa, Artificial Sequence
  Description of Artificial Sequence: Synthetic peptide
  N-term Ac
  MOD_RES (5)..(5): Methionine sulfone
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAMALXAIGDAFNAYYA

SEQ ID NO: 1472 - protein, 21 aa, Artificial Sequence
  Description of Artificial Sequence: Synthetic peptide
  N-term Ac
  MOD_RES (5)..(5): Methionine sulfoxide
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAMALRAIGDALNXFYAHH

SEQ ID NO: 1473 - protein, 21 aa, Artificial Sequence
  Description of Artificial Sequence: Synthetic peptide
  N-term Ac
  MOD_RES (5)..(5): Methionine sulfone
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAMALRAIGDALNXFYAHH

SEQ ID NO: 1474 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGNAVNXFYAHH

SEQ ID NO: 1475 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAARAIGDAVNXFYAHH

SEQ ID NO: 1476 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALAAIGDAVNXFYAHH

SEQ ID NO: 1477 - protein, 21 aa, Artificial Sequence
  Description of Artificial Sequence: Synthetic peptide
  N-term Ac
  MOD_RES (8)..(8): Cit
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALXAIGDAVNXFYAHH

SEQ ID NO: 1478 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGDAVNXFYAHH

SEQ ID NO: 1479 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALRAIGNAVNXFYAHH

SEQ ID NO: 1480 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQAARAIGDAVNXFYAHH

SEQ ID NO: 1481 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALAAIGDAVNXFYAHH

SEQ ID NO: 1482 - protein, 21 aa, Artificial Sequence
  Description of Artificial Sequence: Synthetic peptide
  N-term Ac
  MOD_RES (2)..(2): (S)-2-amino-3-(7-(diethylamino)-2-oxo-2H-chromene-3- carboxamido)propanoic acid
  MOD_RES (8)..(8): Cit
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RXIAQALXAIGDAVNXFYAHH

SEQ ID NO: 1483 - protein, 19 aa, Artificial Sequence
  Description of Artificial Sequence: Synthetic peptide
  N-term Ac
  MOD_RES (3)..(3): Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1484 - protein, 19 aa, Artificial Sequence
  Description of Artificial Sequence: Synthetic peptide
  N-term Ac
  MOD_RES (3)..(3): hhLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1485 - protein, 19 aa, Artificial Sequence
  Description of Artificial Sequence: Synthetic peptide
  N-term Ac
  MOD_RES (3)..(3): Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1486 - protein, 19 aa, Artificial Sequence
  Description of Artificial Sequence: Synthetic peptide
  N-term Ac
  MOD_RES (3)..(3): homo-Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1487 - protein, 19 aa, Artificial Sequence
  Description of Artificial Sequence: Synthetic peptide
  N-term Ac
  MOD_RES (3)..(3): homo-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1488 - protein, 19 aa, Artificial Sequence
  Description of Artificial Sequence: Synthetic peptide
  N-term Ac
  MOD_RES (3)..(3): Indanyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1489 - protein, 19 aa, Artificial Sequence
  Description of Artificial Sequence: Synthetic peptide
  N-term Ac
  MOD_RES (3)..(3): Phe-4CF3
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1490 - protein, 19 aa, Artificial Sequence
  Description of Artificial Sequence: Synthetic peptide
  N-term Ac
  MOD_RES (3)..(3): Phe-4tBu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1491 - protein, 19 aa, Artificial Sequence
  Description of Artificial Sequence: Synthetic peptide
  N-term Ac
  MOD_RES (3)..(3): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1492 - protein, 19 aa, Artificial Sequence
  Description of Artificial Sequence: Synthetic peptide
  N-term Ac
  MOD_RES (3)..(3): Bip
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1493 - protein, 19 aa, Artificial Sequence
  Description of Artificial Sequence: Synthetic peptide
  N-term Ac
  MOD_RES (7)..(7): Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1494 - protein, 19 aa, Artificial Sequence
  Description of Artificial Sequence: Synthetic peptide
  N-term Ac
  MOD_RES (7)..(7): hhLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1495 - protein, 19 aa, Artificial Sequence
  Description of Artificial Sequence: Synthetic peptide
  N-term Ac
  MOD_RES (7)..(7): Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1496 - protein, 19 aa, Artificial Sequence
  Description of Artificial Sequence: Synthetic peptide
  N-term Ac
  MOD_RES (7)..(7): homo-Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1497 - protein, 19 aa, Artificial Sequence
  Description of Artificial Sequence: Synthetic peptide
  N-term Ac
  MOD_RES (7)..(7): Homo-Adamantyl glycine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1498 - protein, 19 aa, Artificial Sequence
  Description of Artificial Sequence: Synthetic peptide
  N-term Ac
  MOD_RES (7)..(7): homo-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1499 - protein, 19 aa, Artificial Sequence
  Description of Artificial Sequence: Synthetic peptide
  N-term Ac
  MOD_RES (7)..(7): Indanyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1500 - protein, 19 aa, Artificial Sequence
  Description of Artificial Sequence: Synthetic peptide
  N-term Ac
  MOD_RES (7)..(7): Phe-4CF3
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1501 - protein, 19 aa, Artificial Sequence
  Description of Artificial Sequence: Synthetic peptide
  N-term Ac
  MOD_RES (7)..(7): Phe-4tBu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1502 - protein, 19 aa, Artificial Sequence
  Description of Artificial Sequence: Synthetic peptide
  N-term Ac
  MOD_RES (7)..(7): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1503 - protein, 19 aa, Artificial Sequence
  Description of Artificial Sequence: Synthetic peptide
  N-term Ac
  MOD_RES (7)..(7): Bip
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAXRAIGDAFNAYYA

SEQ ID NO: 1504 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Cyclobutyl alanine
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1505 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  C-term NH2
IWIAQALRALGDAFNAYYA

SEQ ID NO: 1506 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Cyclohexyl-Ala
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1507 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Tert-Butyl-alanine
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1508 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hhLeu
  MOD_RES (16)..(16): Alpha-Me S5-pentenyl-alanine olefin amino acid connected by an all-carbon crosslinker comprising one double bond
  C-term NH2
IWIAQALRALGDAFNAYYA

SEQ ID NO: 1509 - protein, 19 aa, Artificial Sequence
  Description of Artificial Sequence: Synthetic peptide
  N-term Ac
  MOD_RES (2)..(2): Alpha-Me-Trp
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1510 - protein, 19 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IXIAQALRAIGDAFNAYYA

SEQ ID NO: 1511 - protein, 19 aa, Artificial Sequence
  Description of Artificial Sequence: Synthetic peptide
  N-term Ac
  MOD_RES (1)..(1): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
LWIAQALRAIGDAFNAYYA

SEQ ID NO: 1512 - protein, 19 aa, Artificial Sequence
  Description of Artificial Sequence: Synthetic peptide
  N-term Ac
  MOD_RES (3)..(3): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1513 - protein, 19 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIXQALRAIGDAFNAYYA

SEQ ID NO: 1514 - protein, 19 aa, Artificial Sequence
  Description of Artificial Sequence: Synthetic peptide
  N-term Ac
  MOD_RES (5)..(5): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAXALRAIGDAFNAYYA

SEQ ID NO: 1515 - protein, 19 aa, Artificial Sequence
  Description of Artificial Sequence: Synthetic peptide
  N-term Ac
  MOD_RES (7)..(7): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1516 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1517 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRAIGDAFNAFYA

SEQ ID NO: 1518 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAAYA

SEQ ID NO: 1519 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
IWIAQALRAIGDAFNAYFA

SEQ ID NO: 1520 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQALRAIGDAFNAYYX

SEQ ID NO: 1521 - protein, 19 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIAQALRAIGDEFNAYYA

SEQ ID NO: 1522 - protein, 19 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IWIAAALRAIGDEFNAYYA

SEQ ID NO: 1523 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Two pentenyl-alanine olefin side chains, each of which is crosslinked to another amino acid as indicated
  MISC_FEATURE (16)..(20): Crosslink between residues
  MOD_RES (20)..(20): Alpha-Me R5-pentenyl-alanine olefin amino acid connected by an all-carbon crosslinker comprising one double bond
  C-term NH2
IWIAQALRAIGDEFNAYYAAA

SEQ ID NO: 1524 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAAXAIGDAFNAYYA

SEQ ID NO: 1525 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGNAFNAYYA

SEQ ID NO: 1526 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAANAYYA

SEQ ID NO: 1527 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAVNAYYA

SEQ ID NO: 1528 - protein, 21 aa, Artificial Sequence
  Description of Artificial Sequence: Synthetic peptide
  N-term Ac
  MOD_RES (7)..(7): Cyclohexyl-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAARAIGDALNXFYAHH

SEQ ID NO: 1529 - protein, 21 aa, Artificial Sequence
  Description of Artificial Sequence: Synthetic peptide
  N-term Ac
  MOD_RES (7)..(7): hhLeu
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALRAIGDALNXFYAHH

SEQ ID NO: 1530 - protein, 21 aa, Artificial Sequence
  Description of Artificial Sequence: Synthetic peptide
  N-term Ac
  MOD_RES (7)..(7): Adamantyl-Gly
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAGRAIGDALNXFYAHH

SEQ ID NO: 1531 - protein, 21 aa, Artificial Sequence
  Description of Artificial Sequence: Synthetic peptide
  N-term Ac
  MOD_RES (7)..(7): homo-Cyclohexyl-Ala
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAARAIGDALNXFYAHH

SEQ ID NO: 1532 - protein, 21 aa, Artificial Sequence
  Description of Artificial Sequence: Synthetic peptide
  N-term Ac
  MOD_RES (7)..(7): homo-Phe
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAFRAIGDALNXFYAHH

SEQ ID NO: 1533 - protein, 21 aa, Artificial Sequence
  Description of Artificial Sequence: Synthetic peptide
  N-term Ac
  MOD_RES (7)..(7): Indanyl-Gly
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAGRAIGDALNXFYAHH

SEQ ID NO: 1534 - protein, 21 aa, Artificial Sequence
  Description of Artificial Sequence: Synthetic peptide
  N-term Ac
  MOD_RES (7)..(7): Phe-4CF3
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAFRAIGDALNXFYAHH

SEQ ID NO: 1535 - protein, 21 aa, Artificial Sequence
  Description of Artificial Sequence: Synthetic peptide
  N-term Ac
  MOD_RES (7)..(7): Phe-4tBu
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAFRAIGDALNXFYAHH

SEQ ID NO: 1536 - protein, 21 aa, Artificial Sequence
  Description of Artificial Sequence: Synthetic peptide
  N-term Ac
  MOD_RES (7)..(7): 2-Naphthalanine
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAARAIGDALNXFYAHH

SEQ ID NO: 1537 - protein, 21 aa, Artificial Sequence
  Description of Artificial Sequence: Synthetic peptide
  N-term Ac
  MOD_RES (7)..(7): Bip
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQAXRAIGDALNXFYAHH

SEQ ID NO: 1538 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRRIGDAFNAYYA

SEQ ID NO: 1539 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYYA

SEQ ID NO: 1540 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (8)..(8): Cit
  MOD_RES (13)..(13): Alpha-Me S5-pentenyl-alanine olefin amino acid connected by an all-carbon crosslinker comprising one double bond
  C-term NH2
IWIAQALXRIGDAFNAYYA

SEQ ID NO: 1541 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (8)..(8): Cit
  MOD_RES (13)..(13): Alpha-Me S5-pentenyl-alanine olefin amino acid connected by an all-carbon crosslinker comprising one double bond
  C-term NH2
IWIAQALXAIGDAFNAYYA

SEQ ID NO: 1542 - protein, 19 aa, Artificial Sequence
  Description of Artificial Sequence: Synthetic peptide
  N-term Ac
  MOD_RES (5)..(5): Methionine sulfoxide
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAMALXAIGDAFNAYYA

SEQ ID NO: 1543 - protein, 19 aa, Artificial Sequence
  Description of Artificial Sequence: Synthetic peptide
  N-term Ac
  MOD_RES (5)..(5): Methionine sulfone
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAMALXAIGDAFNAYYA

SEQ ID NO: 1544 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALDAIGRAFNAYYA

SEQ ID NO: 1545 - protein, 21 aa, Artificial Sequence
  Description of Artificial Sequence: Synthetic peptide
  N-term Ac
  MOD_RES (9)..(9): Alpha-Me S5-pentenyl-alanine olefin amino acid connected by an all-carbon crosslinker comprising one double bond
  MISC_FEATURE (9)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): 2-aminoisobutyric acid
  C-term NH2
RWIAQALDAIGRALNXFYAHH

SEQ ID NO: 1546 - protein, 23 aa, Artificial Sequence
  Description of Artificial Sequence: Synthetic peptide
  N-term Ac
  MOD_RES (12)..(12): Alpha-Me R8-octenyl-alanine olefin amino acid connected by an all-carbon crosslinker comprising one double bond
  MISC_FEATURE (12)..(19): Crosslink between residues
  MOD_RES (19)..(19): Alpha-Me S5-pentenyl-alanine olefin amino acid connected by an all-carbon crosslinker comprising one double bond
  C-term NH2
RPEIWIAQAIDAIGDAVNAYYAR

SEQ ID NO: 1547 - protein, 23 aa, Artificial Sequence
  Description of Artificial Sequence: Synthetic peptide
  N-term Ac
  MOD_RES (12)..(12): Alpha-Me S5-pentenyl-alanine olefin amino acid connected by an all-carbon crosslinker comprising one double bond
  MISC_FEATURE (12)..(16): Crosslink between residues
  MOD_RES (16)..(16): Alpha-Me S5-pentenyl-alanine olefin amino acid connected by an all-carbon crosslinker comprising one double bond
  C-term NH2
RPEIWIAQAIDAIGDAVNAYYAR

SEQ ID NO: 1548 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
DWIAQALRAIGDAFNAYYR

SEQ ID NO: 1549 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1550 - protein, 19 aa, Artificial Sequence
  Description of Artificial Sequence: Synthetic peptide
  N-term Ac
  MOD_RES (3)..(3): Tert-Butyl-alanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1551 - protein, 19 aa, Artificial Sequence
  Description of Artificial Sequence: Synthetic peptide
  N-term Ac
  MOD_RES (3)..(3): hLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1552 - protein, 19 aa, Artificial Sequence
  Description of Artificial Sequence: Synthetic peptide
  N-term Ac
  MOD_RES (3)..(3): Cyclohexyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1553 - protein, 19 aa, Artificial Sequence
  Description of Artificial Sequence: Synthetic peptide
  N-term Ac
  MOD_RES (3)..(3): Ac6c
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1554 - protein, 19 aa, Artificial Sequence
  Description of Artificial Sequence: Synthetic peptide
  N-term Ac
  MOD_RES (3)..(3): Ac5c
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1555 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
EWIAAALRAIGDAFNAYYA

SEQ ID NO: 1556 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
RWIAAALRAIGDAFNAYYA

SEQ ID NO: 1557 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
KWIAAALRAIGDAFNAYYA

SEQ ID NO: 1558 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
HWIAAALRAIGDAFNAYYA

SEQ ID NO: 1559 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
SWIAAALRAIGDAFNAYYA

SEQ ID NO: 1560 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
QWIAAALRAIGDAFNAYYA

SEQ ID NO: 1561 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
AWIAAALRAIGDAFNAYYA

SEQ ID NO: 1562 - protein, 19 aa, Artificial Sequence
  Description of Artificial Sequence: Synthetic peptide
  N-term Ac
  MOD_RES (1)..(1): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
XWIAAALRAIGDAFNAYYA

SEQ ID NO: 1563 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
FWIAAALRAIGDAFNAYYA

SEQ ID NO: 1564 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IDIAAALRAIGDAFNAYYA

SEQ ID NO: 1565 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IRIAAALRAIGDAFNAYYA

SEQ ID NO: 1566 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IHIAAALRAIGDAFNAYYA

SEQ ID NO: 1567 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
ISIAAALRAIGDAFNAYYA

SEQ ID NO: 1568 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
INIAAALRAIGDAFNAYYA

SEQ ID NO: 1569 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
ILIAAALRAIGDAFNAYYA

SEQ ID NO: 1570 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IFIAAALRAIGDAFNAYYA

SEQ ID NO: 1571 - protein, 19 aa, Artificial Sequence
  Description of Artificial Sequence: Synthetic peptide
  N-term Ac
  MOD_RES (2)..(2): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAAALRAIGDAFNAYYA

SEQ ID NO: 1572 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWISAALRAIGDAFNAYYA

SEQ ID NO: 1573 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWILAALRAIGDAFNAYYA

SEQ ID NO: 1574 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIFAALRAIGDAFNAYYA

SEQ ID NO: 1575 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIALALRAIGDAFNAYYA

SEQ ID NO: 1576 - protein, 19 aa, Artificial Sequence
  Description of Artificial Sequence: Synthetic peptide
  N-term Ac
  MOD_RES (8)..(8): 4-guanido-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALFAIGDAFNAYYA

SEQ ID NO: 1577 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALKAIGDAFNAYYA

SEQ ID NO: 1578 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (11)..(11): Abu
  MOD_RES (16)..(16): Alpha-Me S5-pentenyl-alanine olefin amino acid connected by an all-carbon crosslinker comprising one double bond
  C-term NH2
IWIAAALRAIXDAFNAYYA

SEQ ID NO: 1579 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIVDAFNAYYA

SEQ ID NO: 1580 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGEAFNAYYA

SEQ ID NO: 1581 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAGNAYYA

SEQ ID NO: 1582 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAWNAYYA

SEQ ID NO: 1583 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): homo-Phe
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1584 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Phe-4CF3
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1585 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Phe-4tBu
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1586 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): 2-Naphthalanine
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1587 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Bip
  MOD_RES (16)..(16): Alpha-Me S5-pentenyl-alanine olefin amino acid connected by an all-carbon crosslinker comprising one double bond
  C-term NH2
IWIAQALRAIGDAXNAYYA

SEQ ID NO: 1588 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFDAYYA

SEQ ID NO: 1589 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFEAYYA

SEQ ID NO: 1590 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFQAYYA

SEQ ID NO: 1591 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFSAYYA

SEQ ID NO: 1592 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFHAYYA

SEQ ID NO: 1593 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNALYA

SEQ ID NO: 1594 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYAA

SEQ ID NO: 1595 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYLA

SEQ ID NO: 1596 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): Cyclohexyl-Ala
  C-term NH2
IWIAQALRAIGDAFNAYAA

SEQ ID NO: 1597 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): homo-Phe
  C-term NH2
IWIAQALRAIGDAFNAYFA

SEQ ID NO: 1598 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYWA

SEQ ID NO: 1599 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): 2-Naphthalanine
  C-term NH2
IWIAQALRAIGDAFNAYAA

SEQ ID NO: 1600 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYD

SEQ ID NO: 1601 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYE

SEQ ID NO: 1602 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYQ

SEQ ID NO: 1603 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYS

SEQ ID NO: 1604 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYH

SEQ ID NO: 1605 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYR

SEQ ID NO: 1606 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYK

SEQ ID NO: 1607 - protein, 19 aa, Artificial Sequence
  Description of Artificial Sequence: Synthetic peptide
  N-term Ac
  MOD_RES (9)..(9): Alpha-Me R6-hexynyl-alanine alkynyl amino acids, crosslinked via a dialkyne bond to a second alkynyl amino acid
  MISC_FEATURE (9)..(16): Crosslink between residues
  MOD_RES (16)..(16): Alpha-Me S5-pentynyl-alanine alkynyl amino acids, wherein the alkyne forms one half of a dialkyne bond with a second alkynyl amino acid
  C-term NH2
IWIAQALRAIGDAFNAYYA

SEQ ID NO: 1608 - protein, 19 aa, Artificial Sequence
  Description of Artificial Sequence: Synthetic peptide
  N-term Ac
  MOD_RES (7)..(7): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1609 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1610 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRAIGDAFNAFYA

SEQ ID NO: 1611 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQALRAIGDAFNAYYX

SEQ ID NO: 1612 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAAXAIGDAFNAYYA

SEQ ID NO: 1613 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGNAFNAYYA

SEQ ID NO: 1614 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAANAYYA

SEQ ID NO: 1615 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAVNAYYA

SEQ ID NO: 1616 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRAIGDAFNAYYA

SEQ ID NO: 1617 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (8)..(8): Cit
  MOD_RES (13)..(13): Alpha-Me S5-pentenyl-alanine olefin amino acid connected by an all-carbon crosslinker comprising one double bond
  C-term NH2
IWIAQALXAIGDAFNAYYA

SEQ ID NO: 1618 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAAYA

SEQ ID NO: 1619 - protein, 19 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  MISC_FEATURE (6)..(13): Crosslink between residues
  MOD_RES (13)..(13): Alpha-Me S5-pentenyl-alanine olefin amino acid connected by an all-carbon crosslinker comprising one double bond
  C-term NH2
IWIAQALRRIGDAFNAYYA

SEQ ID NO: 1620 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRALGDAFNAFYA

SEQ ID NO: 1621 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
IWIAQALRALGDAFNAYFA

SEQ ID NO: 1622 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (17)..(17): Phe-4F
  MOD_RES (18)..(18): Phe-4F
  C-term NH2
IWIAQALRALGDAFNAFFA

SEQ ID NO: 1623 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
AWIAAALRALGDAFNAYFA

SEQ ID NO: 1624 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
AWIAAALRALGDAFNAAFA

SEQ ID NO: 1625 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (17)..(17): Phe-4F
  MOD_RES (18)..(18): Phe-4F
  C-term NH2
IWIAQAARALGDAFNAFFA

SEQ ID NO: 1626 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYARR

SEQ ID NO: 1627 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQELRAIGDEFNAYYARR

SEQ ID NO: 1628 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
WIAQALRAIGDAFNAYYA

SEQ ID NO: 1629 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFAAYYA

SEQ ID NO: 1630 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYAA

SEQ ID NO: 1631 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1632 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
WIAQALRAIGDAFNAYYA

SEQ ID NO: 1633 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYYA

SEQ ID NO: 1634 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAAALRAIGDAFNAYYA

SEQ ID NO: 1635 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALAAIGDAFNAYYA

SEQ ID NO: 1636 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIADAFNAYYA

SEQ ID NO: 1637 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAANAYYA

SEQ ID NO: 1638 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAAYA

SEQ ID NO: 1639 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDEFNAYYA

SEQ ID NO: 1640 - protein, 19 aa, Artificial Sequence
  Description of Artificial Sequence: Synthetic peptide
  N-term Ac
  MOD_RES (9)..(9): reduced alpha-Me R8-octenyl-alanine olefin amino acid connected by an all-carbon crosslinker comprising one double bond
  MISC_FEATURE (9)..(16): Crosslink between residues
  MOD_RES (16)..(16): Modified alanine amino acid connected by a reduced olefin crosslinker
  C-term NH2
IWIAQALRAIGDAFNAYYA

SEQ ID NO: 1641 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFAAYYA

SEQ ID NO: 1642 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQANAYYA

SEQ ID NO: 1643 - protein, 20 aa, Artificial Sequence
  Description of Artificial Sequence: Synthetic peptide
  N-term FITC
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDAFNAYYA

SEQ ID NO: 1644 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDAFNAYYA

SEQ ID NO: 1645 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDEFNAYYA

SEQ ID NO: 1646 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYA

SEQ ID NO: 1647 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYA

SEQ ID NO: 1648 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFNAYYA

SEQ ID NO: 1649 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDEFNAYYA

SEQ ID NO: 1650 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDQFNAYYA

SEQ ID NO: 1651 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYA

SEQ ID NO: 1652 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFAAYYA

SEQ ID NO: 1653 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAFNAYYA

SEQ ID NO: 1654 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDQFNAYYA

SEQ ID NO: 1655 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDAFNAYYA

SEQ ID NO: 1656 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDQFNAYYA

SEQ ID NO: 1657 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDAFNAYYA

SEQ ID NO: 1658 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDQFNAYYA

SEQ ID NO: 1659 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1660 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAINAYYA

SEQ ID NO: 1661 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQINAYYA

SEQ ID NO: 1662 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAANAYYA

SEQ ID NO: 1663 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADAFNAYYA

SEQ ID NO: 1664 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADQFNAYYA

SEQ ID NO: 1665 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1666 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDQFNAYYA

SEQ ID NO: 1667 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDAFNAYYA

SEQ ID NO: 1668 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDQFNAYYA

SEQ ID NO: 1669 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1670 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDQFNAYYA

SEQ ID NO: 1671 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALAAIGDAFNAYYA

SEQ ID NO: 1672 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGNAFNAYYA

SEQ ID NO: 1673 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1674 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFAAYYA

SEQ ID NO: 1675 - protein, 19 aa, Artificial Sequence
  Description of Artificial Sequence: Synthetic peptide
  N-term Ac
  MOD_RES (3)..(3): Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1676 - protein, 19 aa, Artificial Sequence
  Description of Artificial Sequence: Synthetic peptide
  N-term Ac
  MOD_RES (3)..(3): hhLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1677 - protein, 19 aa, Artificial Sequence
  Description of Artificial Sequence: Synthetic peptide
  N-term Ac
  MOD_RES (3)..(3): Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1678 - protein, 19 aa, Artificial Sequence
  Description of Artificial Sequence: Synthetic peptide
  N-term Ac
  MOD_RES (3)..(3): homo-Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1679 - protein, 19 aa, Artificial Sequence
  Description of Artificial Sequence: Synthetic peptide
  N-term Ac
  MOD_RES (3)..(3): homo-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1680 - protein, 19 aa, Artificial Sequence
  Description of Artificial Sequence: Synthetic peptide
  N-term Ac
  MOD_RES (3)..(3): Indanyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1681 - protein, 19 aa, Artificial Sequence
  Description of Artificial Sequence: Synthetic peptide
  N-term Ac
  MOD_RES (3)..(3): Phe-4CF3
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1682 - protein, 19 aa, Artificial Sequence
  Description of Artificial Sequence: Synthetic peptide
  N-term Ac
  MOD_RES (3)..(3): Phe-4tBu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1683 - protein, 19 aa, Artificial Sequence
  Description of Artificial Sequence: Synthetic peptide
  N-term Ac
  MOD_RES (3)..(3): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1684 - protein, 19 aa, Artificial Sequence
  Description of Artificial Sequence: Synthetic peptide
  N-term Ac
  MOD_RES (3)..(3): Bip
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1685 - protein, 19 aa, Artificial Sequence
  Description of Artificial Sequence: Synthetic peptide
  N-term Ac
  MOD_RES (7)..(7): Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1686 - protein, 19 aa, Artificial Sequence
  Description of Artificial Sequence: Synthetic peptide
  N-term Ac
  MOD_RES (7)..(7): hhLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1687 - protein, 19 aa, Artificial Sequence
  Description of Artificial Sequence: Synthetic peptide
  N-term Ac
  MOD_RES (7)..(7): Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1688 - protein, 19 aa, Artificial Sequence
  Description of Artificial Sequence: Synthetic peptide
  N-term Ac
  MOD_RES (7)..(7): homo-Cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1689 - protein, 19 aa, Artificial Sequence
  Description of Artificial Sequence: Synthetic peptide
  N-term Ac
  MOD_RES (7)..(7): Homo-Adamantyl glycine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1690 - protein, 19 aa, Artificial Sequence
  Description of Artificial Sequence: Synthetic peptide
  N-term Ac
  MOD_RES (7)..(7): homo-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1691 - protein, 19 aa, Artificial Sequence
  Description of Artificial Sequence: Synthetic peptide
  N-term Ac
  MOD_RES (7)..(7): Indanyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1692 - protein, 19 aa, Artificial Sequence
  Description of Artificial Sequence: Synthetic peptide
  N-term Ac
  MOD_RES (7)..(7): Phe-4CF3
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1693 - protein, 19 aa, Artificial Sequence
  Description of Artificial Sequence: Synthetic peptide
  N-term Ac
  MOD_RES (7)..(7): Phe-4tBu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1694 - protein, 19 aa, Artificial Sequence
  Description of Artificial Sequence: Synthetic peptide
  N-term Ac
  MOD_RES (7)..(7): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1695 - protein, 19 aa, Artificial Sequence
  Description of Artificial Sequence: Synthetic peptide
  N-term Ac
  MOD_RES (7)..(7): Bip
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAXRAIGDAFNAYYA

SEQ ID NO: 1696 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Cyclobutyl alanine
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1697 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  C-term NH2
IWIAQALRALGDAFNAYYA

SEQ ID NO: 1698 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Cyclohexyl-Ala
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1699 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Tert-Butyl-alanine
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1700 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hhLeu
  MOD_RES (16)..(16): Alpha-Me S5-pentenyl-alanine olefin amino acid connected by an all-carbon crosslinker comprising one double bond
  C-term NH2
IWIAQALRALGDAFNAYYA

SEQ ID NO: 1701 - protein, 19 aa, Artificial Sequence
  Description of Artificial Sequence: Synthetic peptide
  N-term Ac
  MOD_RES (2)..(2): Alpha-Me-Trp
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1702 - protein, 19 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IXIAQALRAIGDAFNAYYA

SEQ ID NO: 1703 - protein, 19 aa, Artificial Sequence
  Description of Artificial Sequence: Synthetic peptide
  N-term Ac
  MOD_RES (1)..(1): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
LWIAQALRAIGDAFNAYYA

SEQ ID NO: 1704 - protein, 19 aa, Artificial Sequence
  Description of Artificial Sequence: Synthetic peptide
  N-term Ac
  MOD_RES (3)..(3): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1705 - protein, 19 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIXQALRAIGDAFNAYYA

SEQ ID NO: 1706 - protein, 19 aa, Artificial Sequence
  Description of Artificial Sequence: Synthetic peptide
  N-term Ac
  MOD_RES (5)..(5): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAXALRAIGDAFNAYYA

SEQ ID NO: 1707 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1708 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
IWIAQALRAIGDAFNAYFA

SEQ ID NO: 1709 - protein, 19 aa, Artificial Sequence
  Description of Artificial Sequence: Synthetic peptide
  N-term Ac
  MOD_RES (3)..(3): Tert-Butyl-alanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1710 - protein, 19 aa, Artificial Sequence
  Description of Artificial Sequence: Synthetic peptide
  N-term Ac
  MOD_RES (3)..(3): hLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1711 - protein, 19 aa, Artificial Sequence
  Description of Artificial Sequence: Synthetic peptide
  N-term Ac
  MOD_RES (3)..(3): Cyclohexyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1712 - protein, 19 aa, Artificial Sequence
  Description of Artificial Sequence: Synthetic peptide
  N-term Ac
  MOD_RES (3)..(3): Ac6c
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1713 - protein, 19 aa, Artificial Sequence
  Description of Artificial Sequence: Synthetic peptide
  N-term Ac
  MOD_RES (3)..(3): Ac5c
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1714 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
EWIAAALRAIGDAFNAYYA

SEQ ID NO: 1715 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
RWIAAALRAIGDAFNAYYA

SEQ ID NO: 1716 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
KWIAAALRAIGDAFNAYYA

SEQ ID NO: 1717 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
HWIAAALRAIGDAFNAYYA

SEQ ID NO: 1718 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
SWIAAALRAIGDAFNAYYA

SEQ ID NO: 1719 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
QWIAAALRAIGDAFNAYYA

SEQ ID NO: 1720 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
AWIAAALRAIGDAFNAYYA

SEQ ID NO: 1721 - protein, 19 aa, Artificial Sequence
  Description of Artificial Sequence: Synthetic peptide
  N-term Ac
  MOD_RES (1)..(1): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
XWIAAALRAIGDAFNAYYA

SEQ ID NO: 1722 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
FWIAAALRAIGDAFNAYYA

SEQ ID NO: 1723 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IDIAAALRAIGDAFNAYYA

SEQ ID NO: 1724 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IRIAAALRAIGDAFNAYYA

SEQ ID NO: 1725 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IHIAAALRAIGDAFNAYYA

SEQ ID NO: 1726 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
ISIAAALRAIGDAFNAYYA

SEQ ID NO: 1727 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
INIAAALRAIGDAFNAYYA

SEQ ID NO: 1728 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
ILIAAALRAIGDAFNAYYA

SEQ ID NO: 1729 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IFIAAALRAIGDAFNAYYA

SEQ ID NO: 1730 - protein, 19 aa, Artificial Sequence
  Description of Artificial Sequence: Synthetic peptide
  N-term Ac
  MOD_RES (2)..(2): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAAALRAIGDAFNAYYA

SEQ ID NO: 1731 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWISAALRAIGDAFNAYYA

SEQ ID NO: 1732 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWILAALRAIGDAFNAYYA

SEQ ID NO: 1733 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIFAALRAIGDAFNAYYA

SEQ ID NO: 1734 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIALALRAIGDAFNAYYA

SEQ ID NO: 1735 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALKAIGDAFNAYYA

SEQ ID NO: 1736 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (11)..(11): Abu
  MOD_RES (16)..(16): Alpha-Me S5-pentenyl-alanine olefin amino acid connected by an all-carbon crosslinker comprising one double bond
  C-term NH2
IWIAAALRAIXDAFNAYYA

SEQ ID NO: 1737 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIVDAFNAYYA

SEQ ID NO: 1738 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGEAFNAYYA

SEQ ID NO: 1739 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAGNAYYA

SEQ ID NO: 1740 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAWNAYYA

SEQ ID NO: 1741 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): homo-Phe
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1742 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Phe-4CF3
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1743 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Phe-4tBu
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1744 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): 2-Naphthalanine
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1745 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Bip
  MOD_RES (16)..(16): Alpha-Me S5-pentenyl-alanine olefin amino acid connected by an all-carbon crosslinker comprising one double bond
  C-term NH2
IWIAQALRAIGDAXNAYYA

SEQ ID NO: 1746 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFDAYYA

SEQ ID NO: 1747 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFEAYYA

SEQ ID NO: 1748 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFQAYYA

SEQ ID NO: 1749 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFSAYYA

SEQ ID NO: 1750 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFHAYYA

SEQ ID NO: 1751 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNALYA

SEQ ID NO: 1752 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYAA

SEQ ID NO: 1753 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYLA

SEQ ID NO: 1754 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): Cyclohexyl-Ala
  C-term NH2
IWIAQALRAIGDAFNAYAA

SEQ ID NO: 1755 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): homo-Phe
  C-term NH2
IWIAQALRAIGDAFNAYFA

SEQ ID NO: 1756 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYWA

SEQ ID NO: 1757 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): 2-Naphthalanine
  C-term NH2
IWIAQALRAIGDAFNAYAA

SEQ ID NO: 1758 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYD

SEQ ID NO: 1759 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYE

SEQ ID NO: 1760 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYQ

SEQ ID NO: 1761 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYS

SEQ ID NO: 1762 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYH

SEQ ID NO: 1763 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYR

SEQ ID NO: 1764 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYK

SEQ ID NO: 1765 - protein, 19 aa, Artificial Sequence
  Description of Artificial Sequence: Synthetic peptide
  N-term Ac
  MOD_RES (7)..(7): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1766 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1767 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRAIGDAFNAFYA

SEQ ID NO: 1768 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQALRAIGDAFNAYYX

SEQ ID NO: 1769 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAAXAIGDAFNAYYA

SEQ ID NO: 1770 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGNAFNAYYA

SEQ ID NO: 1771 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAANAYYA

SEQ ID NO: 1772 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAVNAYYA

SEQ ID NO: 1773 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAAYA

SEQ ID NO: 1774 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRALGDAFNAFYA

SEQ ID NO: 1775 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
IWIAQALRALGDAFNAYFA

SEQ ID NO: 1776 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (17)..(17): Phe-4F
  MOD_RES (18)..(18): Phe-4F
  C-term NH2
IWIAQALRALGDAFNAFFA

SEQ ID NO: 1777 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
AWIAAALRALGDAFNAYFA

SEQ ID NO: 1778 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
AWIAAALRALGDAFNAAFA

SEQ ID NO: 1779 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hLeu
  MOD_RES (16)..(16): Alpha-Me S5-pentenyl-alanine olefin amino acid connected by an all-carbon crosslinker comprising one double bond
  MOD_RES (17)..(17): Phe-4F
  MOD_RES (18)..(18): Phe-4F
  C-term NH2
IWIAQAARALGDAFNAFFA

SEQ ID NO: 1780 - protein, 19 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIAQALRAIGDEFNAYYA

SEQ ID NO: 1781 - protein, 19 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IWIAAALRAIGDEFNAYYA

SEQ ID NO: 1782 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Two pentenyl-alanine olefin side chains, each of which is crosslinked to another amino acid as indicated
  MISC_FEATURE (16)..(20): Crosslink between residues
  MOD_RES (20)..(20): Alpha-Me R5-pentenyl-alanine olefin amino acid connected by an all-carbon crosslinker comprising one double bond
  C-term NH2
IWIAQALRAIGDEFNAYYAAA

SEQ ID NO: 1783 - protein, 2010 aa, Artificial Sequence
  Description of Artificial Sequence: Synthetic polypeptide
  MOD_RES (1)..(1001): Any amino acid
  MISC_FEATURE (1)..(1000): This region may encompass 1-1000 residues
  MISC_FEATURE (1001)..(1008): Crosslink between residues
  MOD_RES (1008)..(2010): Any amino acid
  MISC_FEATURE (1009)..(2010): This region may encompass 1-1000 residues
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGDAFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

What is claimed is:

1. A peptidomimetic macrocycle of Formula (Ic):

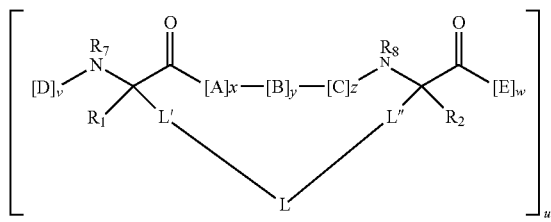

Formula (Ic)

wherein:
each A, C, D, and E is independently a natural or non-natural amino acid;
each B is independently a natural or non-natural amino acid, amino acid analog,

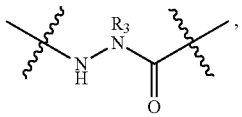

[—NH-$L_3$-CO—], [—NH-$L_3$-$SO_2$—], or [—NH-$L_3$-];
$[A]_x[B]_y$-$[C]_z$ comprises the sequence I-G-D;
each L is independently a macrocycle-forming linker;
each L' is independently alkylene, alkenylene, alkynylene, heteroalkylene, cycloalkylene, heterocycloalkylene, arylene, or heteroarylene, each being optionally substituted with $R_5$, or a bond, or together with $R_1$ and the atom to which both $R_1$ and L' are bound forms a ring;
each L" is independently alkylene, alkenylene, alkynylene, heteroalkylene, cycloalkylene, heterocycloalkylene, arylene, or heteroarylene, each being optionally substituted with $R_5$, or a bond, or together with $R_2$ and the atom to which both $R_2$ and L" are bound forms a ring;
each $R_1$ is independently —H, alkyl, alkenyl, alkynyl, arylalkyl, cycloalkyl, cycloalkylalkyl, heteroalkyl, or heterocycloalkyl, each being optionally substituted with halo, or together with L' and the atom to which both $R_1$ and L' are bound forms a ring;

each $R_2$ is independently —H, alkyl, alkenyl, alkynyl, arylalkyl, cycloalkyl, cycloalkylalkyl, heteroalkyl, or heterocycloalkyl, each being optionally substituted with halo-, or together with L" and the atom to which both $R_2$ and L" are bound forms a ring;

each $R_3$ is independently —H, alkyl, alkenyl, alkynyl, arylalkyl, heteroalkyl, cycloalkyl, heterocycloalkyl, cycloalkylalkyl, aryl, or heteroaryl, each being optionally substituted with $R_5$;

each $L_3$ is independently alkylene, alkenylene, alkynylene, heteroalkylene, cycloalkylene, heterocycloalkylene, arylene, heteroarylene, or [—$R_4$—K—$R_4$—]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each n is independently an integer from 1-5;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope, or a therapeutic agent;

each $R_6$ is independently —H, alkyl, alkenyl, alkynyl, arylalkyl, cycloalkylalkyl, heterocycloalkyl, a fluorescent moiety, a radioisotope, or a therapeutic agent;

each $R_7$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with $R_5$, or part of a cyclic structure with an E residue;

v is an integer from 1-1000, w is an integer from 2-1000 and at least two E amino acids are His residues;

u is an integer from 1-10; and the sum of x+y+z is 3, 4, 5, 6, 7, 8, 9, or 10, or a pharmaceutically-acceptable salt thereof.

2. The peptidomimetic macrocycle of claim 1, wherein the peptidomimetic macrocycle comprises two crosslinks, wherein a first crosslink is of a first pair of amino acid residues, and a second crosslink is of a second pair of amino acid residues.

3. The peptidomimetic macrocycle of claim 2, wherein the first pair of amino acid residues and the second pair of amino acid residues do not share a common amino acid residue.

4. The peptidomimetic macrocycle of claim 2, wherein the first pair of amino acid residues and the second pair of amino acid residues share one common amino acid residue.

5. The peptidomimetic macrocycle of claim 1, wherein the peptidomimetic macrocycle comprises a helix.

6. The peptidomimetic macrocycle of claim 1, wherein the peptidomimetic macrocycle comprises an α-helix.

7. The peptidomimetic macrocycle of claim 1, wherein v is an integer from 1 to 15.

8. The peptidomimetic macrocycle of claim 1, wherein L is

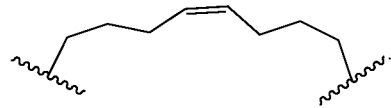 [SMILES: *CCC/C=C\CCC*]

9. The peptidomimetic macrocycle of claim 1, wherein $R^1$ and $R^2$ are H.

10. The peptidomimetic macrocycle of claim 1, wherein $R^1$ and $R^2$ are methyl.

11. A pharmaceutical composition comprising a peptidomimetic macrocycle of claim 1 and a pharmaceutically-acceptable carrier.

12. A method of treating a disorder, the method comprising administering to a subject in need thereof a therapeutically-effective amount of the peptidomimetic macrocycle of claim 1.

13. The method of claim 12, wherein the disorder is a cancer.

14. The method of claim 13, wherein the cancer is resistant to a BCL-2 inhibitor therapy.

15. The peptidomimetic macrocycle of claim 1, wherein L is the formula -$L^1$-$L^2$-, and $L^1$ and $L^2$ are independently alkylene, alkenylene, or alkynylene.

16. The peptidomimetic macrocycle of claim 1, wherein L is the formula -$L^1$-$L^2$-, and $L^1$ and $L^2$ are independently $C_3$-$C_{10}$ alkylene or $C_3$-$C_{10}$ alkenylene.

17. The peptidomimetic macrocycle of claim 1, wherein L is the formula -$L^1$-$L^2$-, and $L^1$ and $L^2$ are independently $C_3$-$C_6$ alkylene or $C_3$-$C_6$ alkenylene.

* * * * *